United States Patent 10,233,495 (METHODS AND COMPOSITIONS FOR SCREENING AND TREATING DEVELOPMENTAL DISORDERS) - sequence listing, part 140

SEQ ID NO: 690 - DNA, 363909 bp, Homo sapiens
ccactaattgagaatattattcagtccaacctcaatacagatttatggtcagtgtcaccctttcctaggaacaggcagcacgctgtggtggaagggtcacagactcggaagaaagcatatctttgatccgtcctaactcagtttctcctaagagacgcagtcttgtgcaatacccttaatctgcctgagcgttagttttcttagctgcaaaatggagtttataattcttgatctgtttcacaaatatgtcataagaataaagaaatatgaactaaaatgttttgacaatgatggattatctaaataccaaccatgcttgtagatgttcttaaagttcatatcaaaggggttaggagaaatgataaaggattactctaggtttgctttttattcaggtatttattcatgtggttgaacatcttaaagccgaagaaagagtaaaatgctggtgaaaactcaggtattattttctgtatcactggatgctagaaatgattactggaaaaaactctttaatgaaacatgctacctgaacactccaggagggagatgagcagaggaaaatgtctttggccttttccccagtgaagcctgatcctttatgacttggctttcatcgatattttgcgcactcaacagagaccctcaaatatgtttattgagaattcactgtgaaaaccgcactcccttaggcactgtgtgaaagggaaagaaaagaaggatgtgagaaagagggatgtttatgcgctttctagagcttctactcagcctggtatgattccaagcagacatttactgtgttacacagatgctatatcaggttctggaagaagttttcctccataaagataacttgcatcctaattgtgttaccatgtcacttaaatagcttctatcagggtcatttctgccagtaaccctcataaggaatcaaggactctctgatgtcagtaaaggcaagatgtcaaggaagctgcaccaactttcttataaggacgggaagagaatatatatctctgcttacccaaagacaaatatttgaacttctttttctgttttctcatcagtggtagaatgctgtgatatttcccttctctttctcttttggccacaccagacaggagaagggaatttaaggaaatgtggagcatagtagttacagggaagatggaaaaagacatgtgttgtttgagtttgtttcaacattgatgaggtgtgttgggcagtatgaagagggagaagagagtgagagcaagaaggaactgtagggaacacaaataggacagaggacagggagaaaaagaagacatgcgtgagattaaaagaaactggccgggcaccgtggctcatgcctgtaaccccagcactttgggaggctgaggtgggcggatcatgaggtcaggagattgagaccatcctggctaacatggtgaaaccccgtctctactaaaaatagaaaaaattagcagagcatggtggcgggcgcctgtagtcccagctactcgggaggctgaggcaggagaatggcctgaacccaggaggcggagcttgcagtgagcggagattgtgccactgcactccagcctgggcaacagagcgagactccgtctcaaaaaaaaaaaaaaaaaaaaaaaaaaaatagaaaagtccctataggcaaggttagcataaggcaaaattgtgaagtacttagtgtgtatcgtccggaacaggtcttttttgctctgcaatccttcacatgctacagaaacattgcagtctcttttatcaggatctagtctatgatttgttatgatctgtcactttgagataaacatgattggtaagtgttaaagtgttactctcccctgtttttcatttcttttattttgttttgccatttttttagggggaggcagatgaatacattttgtgttaaaatttcatgcattgatactatcggggaagtatagacttctaagagaatatctgattgagacagaaaattatgtaatagttcagaacatgaattttgaatttgcctttgggtaagctgatttccctgaggctgtttttttaacgtggaaaatcagagtaataataattgctatctcgtaaatatattttttaaatttctttttaatttttgtccttttttaagtagagacgggttttcaccatgttggccaggctggtctcaaactcctgacctcaagtgatctgcccgcctcggcctcccaaagtgctgggattacaggcgtgagccaccatgcccagcctatttttaaaatttcataaaattttttacactagaaattgttcactatgttgtactattgtcgttattatttttcaactcattttggctatgagcactaaactctaacctgaatatcatagtttcctagtttctgaggcaatttggactaaggcagtttcagaactaacacaagagaatctggaattgtctttataagactgatgtccctgtgtctgaagggaggccacggaagcccagccattccctgacatgcgctccagtttcactcttagagagtaagtaggagtgggcgggctttgtccccagtcctgccacccagcctccttttccctggggtttcctatggaaggagctgcgtgtgtaaagagcaacactcagcgacacatcaaacccagtgtctctctggctggacccgtcctcagcagagcccctagagcgcttctggttccagctgcatttgaaaactggcttttggccgggcgcggtggctcacgcctgtcatcccagcactctgggaggccgaggcgggtggatcacgaggtttggagttcgagaccagcctggctaatatggtgaaaccccgtctctactaaagatacaaaaaattagccgggcgtggtgtccggtgcctgtagtcccagctactcgggaggctgaggcaggagaatcacttgaacctgggaggcggaggttgtagtgagccgagatcgagccactgcactccagcctggcaacagagcgagactctgtctcaaaaaaaaaaaataaataaaaataaataaataataaaactggctttttccaggaggcctgcgtgaggactcttgcttcctcttcactctcttacatctaagatgctggactgaggaggaggctgcggcctgatttgccctcccagccttagctgagaagctggaaagagtggagggagatgaggatttccagcacagcctccacttggcagtccacctttagaggccaggccaggctacagcagggagtctgaggaccaacgggactcagggcagggcctgggttccccggtaagaccaggttgggccatgtactggcaaatgtggtccaacgactgacctaatggaaaaataatttctgtaggcaaaaggtctggccagggtataaggagggacaaaaggaagcggtaggaacatggggaggaagttctctccttataaaaattgtataagatttgaactgttctatctcaacatgtttttgaatgtgtatcattgaaaaacaatggagtcgggtgtggatgctaaaattattttagatagttctttcactgtggcccccattgccccgagaaaatgttccctgagtcccatcaattctaaaaagcactaaacattttgtttaaaaaatagatctggccggtgtggtggctcaggcctgtaatcccagcactctgggaggccaagacgggtggatcacctgaggtcaggagtttgtgaccagcctggacaacatggtgaaaccccgtttctaccaaaaaatacaaaaacttagctgggtgtggtggcgggcaactgtaatcccagctactcaggaggctgaggcaggagggctgcttgaacccaggaggagggggatgcagtgagctgagatcgtgccactgcactccagtctgggtgacagagcaagactccatctcaaaaataaataaataaataaataaaaataaatcgatctgaaaaaaaaattaaggaaatgatgactagaaacttcacaagtgagaagttatttgtccaggagaatcggtgacttactgtatttcttttagttagattgtatcaaggtatgattacaaaaatcaataacaattttatagaaaataaacagagaagcaacaagctaaacctattgagagaacataacttgactgtcattttatgtatataatacagtattatttataaaactgtaatagataagagtcaggtatacagtatacatttcaaagtattaccacagtatttacagttatctataattgtagagttgttaacatgtacttttatctggatttcttaccttaacaaaatacggtcactctatcaatctcagagaaatgtctgtgcaattagtattttggtgttaactttgagtctttataaggtcatatactcatttttcaaaacgaaaagtatttccactgtagaaagatgtctgttgagaaaataaatctcccttcagcacaattttaatttcaaaatgctgcaatacccagaccacaatcctagctagcattaagaaaaatcacatcgtacaaggaattatcactaacaaaggaataaggattttgaaggccgttctcaaggaaagagccgcattgttgagtaggagtaatctcaggggatggctgatatcaaaggaacggtggagtctttctgcttccagtacaggatggagcacaaagcaagattgattgtcatgttttacctgcaatcagggtgagggaaaaaacgaaagggcttttcaagagttgaaggaaaaggctttaaggcagaacaagtggagattagagcttttgtttcacagtgatgtttgctttcatttatacacattcctgatttatacttaataacatgaaagtggctaattttcctattcgtaaaaaatattgctaagtgtgcaaatatgaattactcactgcttctctttaaatgtactcagttaacaggtcaggttttcttttttaattttttttttttgagaccagagtctcactctgtaccccaggctgaagtgcagtggcgcgatcttggctcactgcaaactccgcctcccaggttcaagtgattcttctgcctcagcctcctaagtagctgggattacaggcatgtgcccctacgcccagctaatttttgaatttttagtagagacggggtttcaccatgttggctaggctggtcttgatcccttgacctcgtgatccgcctgcctcggcctccaaaagtgctgggattacaggcgtgaaccactgtgcctggccttaattctttttttttttttaattagcaaacgaaacaatcaacaaggtgaagagacagcccacagaacgggagaaaatatttgcagtttatcgaactgacaagtgattagtaaccagaatatacaaggagtccaaacaactcaaaaacaaaaaaacaaataatctgattttaaaataggcaaaagatctgaacagacatttctcaaaagaagagatacaaatggccaacaggtattaaaaaaaagttcaacatcactaatcatcagagaaattcaaatcaaaataatcatgagctatcatctcatcgcacttaaaatggcttttatcaaaaagacaggcaataagggatgctggcaaggatgtggagaaaggggaaccattgtacactgttggtgggaattaaattagtacaaccactatggagaacggtttggaggttcctcaaaaaactaaaaatagacctaccatatgatccagcaatcccaccgggtatatacacaaaagaaaagcaatcagtctattgaagaggtgtctgcatttccatgtttattgcagcactgttcacaatagccaagatgtggaatcaatctaagtgtccatcagcagacgaatgggtaaatgaaatgtggtacatatatagagagaatggaatattcttcagccataaaaagaatgaaatcatgtcatttacaacaacgtgaatggaactggaggatattatgtgaagtgatgaaataagccaggcacagaaggacaaatattgcatgttcccactcacgtttgggaagtaaaacaatgatcttacggaaatagagagtagaattgtggttatcagagtctggaagggtagtggtgggggagatgaagaaagaattgttaacaggtacaaaaatacatttagatagaaggaataagatgtaatgttcagtagctcaatagggtaaacatagttaacagtaatttattgtgtatttcaaaataactagaagatgggaattggaatgtttctgacacaaagaaatgataaatgcttgaggtgatgggcatcccattaccctgatttgatcattacgtgttgtatgtgttgtatgcttatatcaaaatttcacatgtaccccaaaatatggacgactatgatgtattcaaaaactaaaaataaaaaaattatgaatacgagcaactagcatctaggcaactgggtctgctctgtttaatgatttcaataattcaacaaatatttattgactaccactcatgtattagacactaagatatttgataatgatacaatggtgaatcaacagataaatgatttatcctgatgcttatacattagtaaggaagattaaaaaaactcgtaatcaagttaagtgtgacaggcatcatgtgcttattggaacatgtagaaggggtttctgtgtccctgcaatcaggacaggtctttctgagtctgaagtatgaatcagagttaggtaaagcagagagggaaggcagtttagtttccttggtacaagacagtgtattaaacactgcagtagagagaattgtaaatgataattctgcacttacagaatttgcaattgagtaaatatgagaatattatctaaatgtactgaatgctcattgtgtgctaggtgttattaaatactttacttgtattgattcctttaatcctcacaacaactctatgaaggagttactgttattgaccatctaaaggtgaggaaacagaggaacagaaataggaagtagcttgcacagatcttcctgatctccctcatagccaatgacaggcctaacataacaaatacaatgacaggcctaacatacaaatacttggcgtctgggtccgaagcatgaacttttttttttttttttttttttttttttttttgagacgaagtcttgctctctcacccaggatggagtgcagtggcacgatctcagcttactgcaacctccacctcccaggttcaagcaattccctgccgcagcctcccaagtagctgggattacaggtgcccgccaccacacccggctaatttttggatttttagtagagacggggtttcaccacgttggccaggctggtcacgaactcctgacctaatgatccacctgcctcggcctcctaaagtgctgggattacaggcgtgagccaccgcacccggcctcaaaaacctgcactcttaagaagcattttagtctaagaaaagattgacatatataattgcagatttacaaataactgcaatgcagtaaattacagttactataagagcatccttatgtcggagctcagtggaatgcctagggcttggtgtgccttagctttttaaggaaaatttgtattattttaattatttttatgtacagaaaactcaacagtgtacatttaaccaagtttagtgggaatttctttagcctttgcctttttgagctttggtgcaggtcttcctgtagactagacatcccagtcttgccttccccttgataatgcagtaagggacccccattttacgacacagggcaggcagaaaggtaaccagctcgatgggatccacgtcgtgtgcaatcaccaccagctgagctttcatgttctccaccaaggtggtgacggtgttaactccggctggaaggacaggtggtctcttagtggggacgtcccctttgccggcagctttcttctcagctggggccaacagcctctgccccttctcttgctttgtctttagtctgtacttgtgggccagcttaagcagctgagtagctgtttggcagtccagggcctgggcgaactggtcaatcgcaggaggcactttcagccgcttacagaggatggctctctgccgctgcaacctgatatagcagggccgtttcacaaggtgggcgaggtctcttttgggttggatgtcctgtccaatgccaaaattcttaggccttttctcaaacaggggattcaccactttcttggcctcctgcttcttcatgaccgcaggggccggagccaccttcttccccttggccttctttcctttcggcatcttgagcggcggaaagagagagacgccctttttctttctttctagactctcgctcccatggacttttggtaggtgcactagatagcacacacggttttcccttgaagcaaggcatttctgtctggttgaaagcacactcacggcctctaaatgcttgtcatgcagtctgcaaacaagatgtttaaaggaagttgaaaactcatgtttctccttgtggaagttcatccctctttctgcacaaggtggactacaagaggtccttctggctggaccaaacttattttcaggaagcagctctgaatctgtagaaaagcttgaacattactagttctcagagtgatgctgcataatacaagaagaggctaccttcatttgatgttcctatgattactgtatgtccgcctctaccgtgataccgacttgctaaggattgctaacatttaggcatacttgcatcgtaacaacttaacagtttaactttgactacaaaggccagtgaagggatcgtctactataattttcaattacgttgaaatgtttccacaataactatctttaaacactttatgtgtctagaaatgcaggttacttggtgaaatctaatctcgatggaaagctttgatgctctgtatcaaatgaaaaccaatttaagccatctatgctgcacattaatattaagcaattatattaactgaaagcactgtgaatacatgaattgctttcattaaaaaaagatttccttaattaccttctaagcaaatattctccactaaactttttaagtatttgcaatactcaaataaaataggtaatggagatgtcaatttacatgaaatacatatttctaaaaatctaacttgcattgcaagtttaaaatatgtttacaaaatccagaattaaatataattttataaggctatttttatttggatactgttatgttattcggagaaaacagtatttcttgtttttcatcctttactagctcaaggcttgtcaggatgccactcatatcatattgtgatgttatgatgtatgcccataccactttctgtctcaaggaaaaggtctgtctcctcttatccacattggccgctgtgcccatctctctggtttccatcttgctggcactaaggtagcccctcatgttcacagagaagaaaggctgaggaggtacatgggttttttgtgaccgcaagcttttcagtgcttgtgtgactctaacttctgtgaaatttcttgattttcctcaagtaggacttcagggattcatggaatataaaagatggagctaaaacagactatttcccacatgttcttaggcttaaatgttgaagtgtaaatgtttaagttgtatttatttatttaggacaaattataattgcatgtaattgtggggtgcacaatgatgttgtgatatatgcccacagtttagaatgattgaatcaagccaatgacatatccatctttttttttttttgacagagtcttgctctgttgcccaggctggggtgcagtggcaggatctcagctcactgcaacctccacttcctgggttcaagtgattctcctgcctcagcctcccaagtagctgggactacaggtgcacaccaccatgcccagataatttttttttttgtattttttaatagagatggggtttcaccatgtttgccaggatggtcttgatctcttgaccttgtgagctggctgcctcagcctcccaaagtgctgggattacaggcgtgagccactgtgcccggctccccattttaaatatatatcatttattcctcctgtttaaagcttaataccctttgaccgacacctctcattttccctaccctccagcctctggtaaccaccgttctaccctctgcttctgtgcatttgactttttaaaattccacatgagtgagatcacagggtatttgtctctgtgcctcacttatttcacttaacatagtgtcctccaggttcatccatgttgtaaatgaaataatttctttctttttctttttttctttcttttttttttaaggctgaagaacattccattgtgtgtatatatctcattttctttttccatttatccattgattgacacttagattgattccatgacttggctattgtaaacaatgctgcaacaaacatggaagtgctgatatctcttagacatattaatttcaagtcctaagggtatatagttagaatagggttgctggaacatatggtaatcctatttttagttttctaagggaactccacactgttttctgtaatggctgtgctaatttatattcccaccagtgtacagtgttcccttttcttcacatcctcaccatcacggttgttatctttcctctttttgttgctagctcttctgatagatgatatatcatagttttaatttctatttccctaatgattagtgatattgagcattatatatatatatatatatatatatatatatatatatgtatatatgttggccatttgcatgtcttattttgaaaaatatttattcagtttctttgcccatttttaaattggattttttttttttgctattaacttttttgagctccttatacatttggggtattagttccttatataatgtattgcttgtaaatttttttctgatctgcagattgtctcttcacttgtagttgttttctttgttgtgcaaatattttttagttaactgtaatcttacttgtctatttttgtttttgttatttgatcttttggaggtcaaataaaaaaaaaaaaaaaaaaacattgcccagaccagtgttgtgtagttttctcctctgtgttttcctagtactttttataatttcaggttttacatttaaatctttaattcattttgggtttatttttgtatactctgtgagatagggtgggactaatattattcgtctgcatgtgaatatctcattttctcattgtcctttatgggagagattgttctttacgcattgtgtgtgttcttggcatttttatcaaagtcaattgacgaagggcatcggttcatttttgtgctctctattctgttccattggtcagtgtttctgtttatactagtgtcatgctgttttaattactatggctttgtaatatagtttgaagtcaggtagtgtaagacctctagctttgttcattttgttcaagactgccttggctagtcaggcttttttgtgtgtgtttctgtatgaattttacgatttttttttctatttccatttgcatgaaatatctttttctgttacttcacttttagtctatttgaatctttaatagtgaggtaagtctcttgtaggtagcatatagttgggttttgtttttatacatcctatttctttgtcaagcttctcattttgtattatttttcatattttatttaatcttctatccttatattcttatagctgactgaacttctttaagagaactatattaattttttgttagttatttcatagctctccatttctttagggcctattgttgaagctttatttgtttcttctggagatgtcattattctgattcttcataatctttgtgtccttacattggtgcttgtgcatttgaagaaatggtcacctcttccgtcctttacaggtattctttggcaaagttatactctcactgaagtctagcctgtgattctaggtcggctacctggtaatggcgctaagcaggtagagcttggcgttagactctctagcttgctgagcctctgcctttgctttgagatcagatggatctgagctcttctatttggtgagaccactggctgggttctgcaatcaggcagagatggtagctgggtcctctgattggatgaagacacaatgtgtattccctagttaaatggtactgctgtttgacttttggaatttgggtagggctgcagattgggtcctaagcttaggctgagtcactgattgggagagtcaggatcagctgctaagtttggcagaaatgcacaatattgaggtttacttccctgcctggatgtagctttggtgtgggatttgaggttgaggtgagctgctatttgaactcccagactggggtggtctagcccctgtatgtagccaagatatgccatggtgggtgtctcactccatgagcagggtcttcttgggtctggttcttgggatggacttttaggttgagccaaactcctcttaaatgcccaggtggtgcaagtatagtccctgtgctttgccaaaatactctgtggtaggtatctctcttctcagcaggaggaagttgggggaagcctgaagctgagcatggaggctgagcatctagggatttaagctagattgatctttccactgtgcttctggggtaaccagcttagctttgcaggtgggctatggtactcccacctatgtggtgctgtttaagaggctactactggtacctctcatcaggtgcctctgctgacagtaatgcagagctaccaccaagatacaagccctgtctactgtgagtaacatctcctttctttgcttgtatttgaccccaggtgacctagtcatgccatgatcccatgtttcccatgaggtgagaacagattgggcttcctgagaggcatcttggagtgctagttaagctggatggccaccttatgttttatttttccactttagaaactgtggaccaggggaatcctctctatgtggcactgtgcccattggggagggggaaggggtagcacagtcagagtgacactgttgttacctgtctgatgtagtttttatgtggttctgtctcaggtttatttacaattttggaatttttgccaagatggtcttgtatagaaatagttgctagttgaccttttttttggaagggaagagctgagatgtcctattctgccatcttgctgatatcattccctttgtttcaaaatttttaatataaagctattccctaggttaattgcttctaaatgtgaaggttgtattatatcaaaagatataaatttggagtcacatcaaaagaaagaagaagagtgagaaaaactactttaaatcaattatgaggtcaaatatgtgctccaaaatattttttttcttttgcaatgtaaggatcaattcagaaaaaagaaaatgtttgcagaggcctttcttaaatgatattttttcttaatttttatcaacgattgctgcttgtgtttagttttattttaaacagctttattgaactatgatcgacatacactaaacttaaacatttgacaaattttgacatatatatatatatatacatatatataaaacatcactatagtaaaaaaatgagaatatccatttcccaaaagttttctcttgcccctggtagtctcttgcacctgacctttcctgccacctctcccttccaaaaacagtatatactccatttttttctggcttcttttatttatgtcattcagaatgaatattttgagatttatccaagttgtagcatgttattaatagtttattgtttttggtgttgtgtggtatttcattgaatggttagaccattgatggatatttgggttgttttcagtttttggctattacacataaggctgctatgaatgtttatatacaagcttttatgtggacagggattttaatatttattgggtaatacttagaaatggaacagctggtaggtatatggtaggtttacatcgaacttaaaaagctgtcaaaatgttttccaaagtggcagtgccacctcacattcccatcagcagtatatgagaatgtatattacaccacatcctctccagcacttgtatggtcagtttaaaaaacacttgtatagtctaataggtgcatggtggtagttcattgtggttttaatttgcacttcttttgtgaccaaagatgtatagcattgtttgtcattgatagatcttctgtggtaaagtccctattcacagctttggaccatgatttcaattgggttttttgttttttttcatattattgaaatttaggagccattcatatattttgggtccatctcctatatcagatatataattttcaaatttttttcagtctgtggtttatattttaattttatttatttaattaatttttggtggggggagacagggtcttgctttgtcacccaggcaggagtgcagtggtgtgatcacaactcaccgaagcctcaacctcccaggctcaggtgatcctcccacctcagcctcccgagtaactgggacctatgcctgcatggctaatgttattattttttgtagagacagggtctcactatgttgctcaggttggtcttcaacacttgggctcaaatgagtctcctaccacggcctcccaaagtgctgggattacaaatttgagccactgtgcctggccttaattttcttaataatttttatttttatgtttttgtttgagatggggtctcactctgtcgcccaggctggagtgcagtggtgtgatctcagctcactgcaagctccgcctcccgggttcaggccattctcctgcctcagcctagctgggactcaggtgcccgccactatgcttggctaattttgtttttgtatttttagtagagacggggtttcactgtgttagccaggatggtctcgatctcctgacctcgtgatccgcccgtcttggcctcccaaagtgctgagattacaggtgtgaaccaccgtgcccggctgaagagcaggagttttatgttttgttaaagtacaatttattactactttcttttatggctcatcattttgtcatctgtaagatattgttaccttatctaagatcaccgaggttttttttttcttttgtttttctggaatttttaagggatttggcttagtctcctggagatggagtgagaacaaagatcctagagaaatagtgatggagttatatttgggtgaggctgcaaagaagattggtgtggggttctggaaagagcaggggtctttttcaaaatgatcataagcagtactctggggatgtgtgaaaaactcagaaagaattcctttgactacttggtgctgtttaagaggctactactggccgggcccagtggctcatgcctgtaatcctagcactttgcggggctgaggcgtgcagatcacctgaggtcaggagtacaagatcatcctggccaacatggtgaaaccctgtctctactaaaaatacaaaaaaattacctgggcatggtggcgcacacctgtaatttcagctactcggaggctgagacaagataaattacttgaacccgggaggcagaggttgcagtgagctgagatcgtgacactgccctccatcctggagatcgagactctgcctttaaaaaaaaaaaaaaaaaaaaaagtggctactcccaaggcctagccattttcggttcccaaagatctatggaaatggcagaactggcaacctttaaggaatcacaaaggctaagaaaacaaacatctcagtcttagttacttaactagcacgaactcagatctgaggatgaggggcctccctgatgggcaggaacttggtttgatcatagagtgccaagaatgagctagaatatcctgctagctttgcaatacgcaaacttggtgccaggttaatgcagaattaatttaaagaaaataacaaaatgcaatatctttcatacctcgtagttacaatattaaaactaatacaccacatactatatagattaattccaagttgcataatttctttatactgttcttctcagaatggtagtctaatctaggtctataattcgtgctgacccacggcagtgacctgaaagagttggcactttcagattttgaatatgttgtctcagagcattttctctccacctttgctaaggacacgtctcccctcagctttccgtgtccgtccctgtttcaggcaaggtgagttaggctcacagtgagctccgccagctgtggctgtgtgtatttgtgtgtctgtgtgttgtagtggtaacagcatcagcagtgtttgttgcagatcagctaactctggtaagaagtttcaaagctggttgttatttactttttcgcttttttttttgttccacctgataattttccaagttaattatttatgctgcagaaaaattataatgcgttatgaaagcaattctgtgctgtatcagctttccattttctcttttgatcaaatatcactatatttcatacatattttttcacaattcgcagtttaggattgcagccacttctcggtttcatgatggatggaagtttagtttctagtttttgtatgtttaaataggtctccataggttttaagaatatgtctgatactattttaacaaatctttagcctctggagtatgtattctgtgtgtgtgccaatactactaagaactcagtttctctttaaaacatatttttatgccctccatccctgctccaccccatcatttttcctgggagcagccaaagccatagacagagtaggaatttaaatgtaatttacaaatgctgtccttctcattcctcctcctgtggtgatttgtcccaggcctcctctcttcctcttctaagtctgaatcaatatcagttaacactgtctcgccaacactcctatgagctccacctcacagattagcagagccttttctcatttcagaggtaacagttgaatgtgaatgagttgaatcaggctgatataggtttctactggattttcacttttccacctataaaaatgagaaaaatgagagacagctgaaaaaggaccaaagactgcctctgaggctgtatgagcaagctgcttatccctgaggctgacactgtttcactgacttcaataagatcaaagatggagttggatttgaaccttggtctctcttatttcgagtacattacattagattttgtatttactgtttccttctgttactctaatggaatatgatacggtcatagactatattaattaagacatacttctcaggtataagtgggtatagtataataatgctactgcttttcagtaagtggatcaatttgacacgggaattcacaatttggccattttataaacagaaattataagggactatcttgcagaaaattttgtccaaaattttgattaaaacaggataacaaaataaatttatacaaataaaacttaggaataaagaaggtgacacgtgaccaaacactgcatcaaatttctgttagcacctttaacacatatatcccgacttctaattttttccaaaaacccacatatttttatttatttatatattttttgagatggagtctcgctctatcacccaggctggagtgcagtggcatgatctcagctcactgcaagctctgcctcccaggttcacgccattctcctgcctcagtctcccgtgtagctgggactacaggtgcccgccaccacgcccggctgattttttgtattttcagtagagacggggtttcaccatgttagccaggatggtctcgatctcctgacctcgtgatcagcctgcctaggcctcccaaagtgctgggattacaggcatgagccaccgcacctggcgtccaatttttttatgaaaggtgattttcatatacagtcacaatacttgggcatttgtatgattattcaacaacttgcaaatgatgctgtcaataattttcaagaagaaacaatgctcttccctaatggaagagttgatctggtatattctaatgatctcactcggaacagtgaaatacttaggagagatcttcttcttggactaaatgtaaagacttttaaaaactccagattatactggttatgactttttaataaatatgactttattagatacattttgaagggacttgtgtcttatagaagtataataaaagagcagtctatcatgcgttttaaaccagttactttgaatatcagcctatggcctttaaagctctgaacagttagaactgagctgtatttctgtaattgaaggactgtccacatggcctagagcacattcaaatgatgctcctaaataagcttccagttatcaccgaggcacatgcaaatgggcagaaatttcacatccaatcattgtacaacaggagaaaattctgcttgtataatagaaatgataaccttgaaatacttgagcactcatctttgaggaaagcagaaagacccgaaacctatcatgtgacgagcccgtgaagcctagaatcacagggcagcattaatttcatgggatctagcgaaagaggatctagatggtcattccaagtcctatgtagcctgtttatcatccccattttacatttaaatgtatgcaataggtgtctttacatgagtagactttaaatataggtaatttataggcacaattctttacaaatatttaaacacaatttctaaaattattcaaggttttatcccattgcacagttagactctatttcagttgaaaaatacacgtcaaattgaaaggtgtgaaattatttttttaagccggtactataaattatatgccagaaatatatggtcactttctctagtcatagcaaatgttcaggtaccaagttaactttttaaaaacttttctagaagatccatggaaatcagctgtcacactgcaacaggactcaggaggcctaatatgtgcattcctgatatattcagctgttttaatataaggtagagtaatacagtagaaaacagactacatatggagtcagaaccatatgcagctttcttcactcagtgtttttaaaatgtttaaaaatgcttaacttttttttttttttttttttttttgagacggagactcgctgtgttgcccagcctggagtgcagtggcgcaatctgggctcactgcaagctccgcctcccgggttcccgccattctcctgcctcagcctcccgagcagctgggactacaggtgcccgccaccacacccggctaataaaaatgtttttaaaaacaaaagtgaaccacctttgttcactcattgtttttaaaactttaggtactatttagtgttttggaactttacctgcttattatctgcaacatgaatttaataatatcataaaaactgcatttaaaaagaagatgcactgaggtgatgagtcatatacaactgtgggcaggcaagattttcttgttccctgtacctcgttaactcattagtgcaggatacagattggataacgtctgctagtgaggaactctgtgttaaaatgcctttccataggtgtcactttctcctgtccctgcagtgccaccacaaaagcccagccagctgatggctttagccaatgtggcagcagggagtgtgaggcttctggctttgctaggactcaggccagctgtctccgtcactgggctcagggtgctccctttagttacaaaatcagaccccgtgttgtggagcctgtgcatgtttgcattgctcttttgagttaaaaatcatttagacctaatgagtttaggataaaggactataaacagcctgtcttatccaagttttctgcaatggagtctgccagctcatgcccagctaacgatgtgtctttgaagccattaggtattttctattatttttttgcacataaatatgctttgtggaccttgtagaaagaggtgactagagactggagcaagattcaggtcttcctggatgccctgctaaatgtcatatgattacattggttaaagtcctaattcttcattaataccaacatatgtgatggtgggttgctttcatgtatttctgatagtaatcattagtgctgtttattattaatatgatcattttatccttgatttcctagtatgctgaagaaaagtatgttattcaatcagctttgtgctaaactatagtatatttggcccttaaaagtcctttgcttgctccccgaatgttgaagtttcttactgttccttccaggtcttctcttttcactttccagcataatctcatctgcttttatggcattaattatctctgcattgattacttctaaattcatatctccatgcttaatattttatttgagattcagttccatattaatgtgtctactggattccccagaggcatcttaatatggataaaaaattcatttttatggccaggcacagtggctcacgcctgtaattccagaactttaggaggccgaggtgggcggatcatgaggtcaggagttcgagaccagcctggccaacatggcaaaaccccgtctgtactaaaaatacgaaaattagcctggtgtggtggcaggctcctgtagtcccagctacttgggaggctgaggcaggagaatcacttgaacccgggaggcggaggttgcagtgagccaaaacggtgccattgcactccagcctgggcaacagagtgagaatctgtcccccgccccaaaaaaatcatttttataaccacctacatttattttacttcccgttttaatgaacgaagtcaatagcattatcgcttgcattttcattcggatccactctgctccattctgtcccgtgtcctcttgttcacctgcaaatccacgtagttgctgagtttcagcctattccatctcagggcagagccactgcttggacttccacggcttcacctcagaccctcatccgatgctgccttggctattccaggaaactgctctctgcttctagtcttatcacagctgggaggcaggttctcagccatgctcgccccctacctggaaacagactcggggctgttgtggggggcacggtgagagtgagaccggccctctgggttgtgtgggatccgcccgatactgccacagctgatgctgtcttgaaagcaccacctcccagcaggagcccaaccagcacacaaatagtgcactaaacaaccaaagctaaggaccctcacagagtccacttcaccctcctgccgcctccaccagagcaggtgctggtatccatggctgggagacccacagatgtttcacatcacaggactctgcagacaaccctctttaccagcccatagcctggcagacttgctgggtggctagacccagaagagaaaaaacaatcactgcagttcggctctcaagaagccacatccctaggaaaagggggagagtactacatcaagggaacacccatgggacaaaagactctgaacaacagccttcagccccagaccttccctctgacacagcctacacaaatgagaaggaaccagaaaaccaactctggtaatatgacaaaacaagtttctttaacaccccccaaaatcacactagctcaccagcaatggatccaaaccaagaagaaatccctgattaacctgaaaagaattcagaaggttagttattaagctaaccagggagggctccagagaaaggcaaagcccaatttaaggaagtaaaaaaaaatgacacaagaaatgagggcagaaactttcaatgaaatagatagcataaataaaaaagaatcaaaacttcaggaaacaatggacacacagaaatgcaaaatgctctggaaagtctcagcagtagactcgaacaagcagaagaaagaacttcagagctcaaagacaaggttttcgaattaacccaatgcaacaaagacaaagaaaaaagaataagaatatatgaacaaagcctccaagaagtctgggattgtgttaaatgaccaaacctaagaaaaatcggtattccagaggaagaagagaaaaataaaagtttggaaaacatatttgggggaataatcgaggaatacttccctgactttgctagagacctggacatccaaatacaagaagcacaaagaacacctgggaaattcaccacaaaaagatgattgcctaggcacatggtcatcaggttatctaacgttaagacaaaggaaagcatcctaagagctgtgaggcaaaacaaacaaacaaacaaaacaaaacaaaacaaaaaaccggaacctataaaggaaaacttaccagattaacagcagatttctcagcagaaaccctacaggcgagaaaagatttgtggccctatcttcagcctccttaaacaaaacaattattagccaagaattttgtatccagcaaatctaagcttcataaatgaaggaaagatacagtccttttcagacaaacaaatgctgagagaatttgccactaccaagccagcactacaagaactgctaaaaggagctctaaatcttgaaacaaatcctggaaacatatcaaaacagaacctgtttaaagcataaatctcacaggacctataaaacaaaaatacaattaacaaaacaaaacgaaaaaccgaggtatacaggcgacaataacacaacgaatggaatgatacctcaagtctcaatactagcattgaatgtaaatggcctaaatgctccacttcaaagatacagaattgcagaacggataagccttcaccaaccatctgctgccttcaagagactcacctaacacataaggactcataaaatctcttgctaatttctcctctcctttgctccccaatcctataccagaaggcaagaatgttaatctcttccttaaaattgccgcttgcttcccatctattcaataaagtccaaattacctatcttacgcgtggtttttagttgtctgttgcctacctaatcctctgacctcatattcccaatgtttatatcattcaccatgacttggaacatttcattccttatattatcccttccctagaccttccctctgattatctcttccatctggacctttcccttcctcaatgggcaatttccattcattatttaaggctcagcttaatttactccgttgtggagctcttccttatcactccctagtcagtcgctccctccccagcactgtctctaggcttgtatcacagcaccacaccacctgctgacttgtcagcctggctcatgataccttgctgcctttaatcaagtctggttcttcaattatgatcacagtgtttgctacatagtagaagataaagaaatacttgtctgttggatgaatggtcaagtagcaatgaactttgcctattctttttcaacataagtaacttacaatacttcttttactctcattgaaggtatttaaaataccttcaccacaattttactctcattgaatgtattttaaaatactttcagttcctcacccttcaacatccatctcagccctcagttctactgcagatgcaactatttttaaggcaactttttagatatattgtaaatactgaaaataaaaaataataactatttaaaatgaagatcattcaggaaaacttactatttcatctgcgtttagttcaatatgccaatttcatgtgctgtatttataaaattattctttaataagcatcactaatatatctatgagaagccattaattactgcctctacaaaaggctagtgtcaaaggtaatgttatctcaaaatctgagatgtttaagttccaaactttgtcaattttttttctgtaatcaagaatccacatgttggatgttttactataaaatattactgagtaacatttaacatggatttaaagctggagccaataaatttattatggtgtaaattagcttctttatagaattttctccaaagttgttcgataacatgagagttggaatgaatggaatgtactcaataactatttttaatctatttagttatgaaggaccaaataaatgggtggatggatttctaggcactgtcttgggagacaaaagataaagagtaactaagctgaatttccttcctttggcaaaggctgtcccttaaacaactggtgtattgtcagaaagtgatttaaactatgttcatgcagcaacaagcatctgttttgtaaataaccaaaacattttgttcaggtggcaaagtggtatcttcaatttagaactgaccagcctttggtgaaatgcttctaattaatctaattgcttaattaaatccatgctcaagggatattttttcaaccaaagcctcctaattgtttatcaatgagtgtgattcacattctgctttatctgtgagctccttcttgagctccttaaagatagccaaagacaggggaaaagaggttttagaagcactgcctcacattgaatggaccttagtcggtgcgtagaatagaagctggcaggtcacagtgtttctaagtagagcacagccaaccttaggcttcatcttaccatgaaacatagagcctccttcctttgtgattcacaaagccctttccatcactctggccatccctccagctcttttgcccgtatttccccgtttctgctcttgtttccacacattctctctgaaactctcaaaaataccttctcctccctttccatattttcttcatgtatttttcttttttctttctttttactttttttttttgagacagagtcttgctgtgtcacccaggctggagtgtagtggcgtaatcttggcttactgcaacctctgcctccccagttcaagcaattctcctgactcagcctcctgagtagctgggactacaggcgcccaccaccatgcctggctaattgatatatatatatatatatatatatatatatatatatatatatatatatacacacacacacacacacacacattatatatatatatatatacacacatatataatgtgtgtgtgtatatatatatatatttttttatttttagtagaggtggagtttcaacatgctggccaggctggtcttgagctcctgaccttgtgatccacccgccctggcctcccaaagcgcagggattacagacatgagccaccatgcccggccttcttcatgtatttttcaaattagcaatttatattttttgaaattgaaaataacatccaatagatgaacagcatatcatgccagaagccttgctttcaatgcatttgcatttgctttatcatcgtctcttctgatatcaagcctgagatttctcactctgaaaataattttatctctcgtcaatcttgttatctcagctacatctcttaatgttgattacacccaaatccatgcttactgaacacagtcagatgttctaagtgagctaacatgtgtaaggcatttaatagttgccctggtacttactaagtgacatgaaatttttggctattactattacatcatcatcatcattatcattactattattatcattattcttatgtttctattaggttgcctcagagcaaatcaaatgcatataaccaaatgttttaatccttatgtgtatgttttttaatgtaaattcatagtttccactctcaaacttgtccttcttccttttatgctctgcattgaaccactgttaatttcttaccaacctctgttacatctcttgtattcattttctcttctccacgtagatcctgttgactttggcttacactcatttcatttcactgggattcttctctagatgctcaactttttcttcaaactataattcatcttatctgtggtaatcagtttattttttaaagcatagttctgtttacaagacttctcacaagcttccaagtctctattgcctgttgaataaagttcaccgtccttcatgtgacactgaaggtgttcagtcttccgctttcagataatgtttctggtgcagtcacctgccattttctttcacacctcctagagtgcaacggatctgcatagtatttaatgctcctcattcaatgactatgtagtgaagtgttcctggaagcctggttctagtttaagtgtcttcacccagtgataagactgacacgatcaccgctctgtgattaacattactttgctcacgctcccaactctgctcccttctccaagatacttttgtgctcattcatccacatctgatttatctggtgtgaaactgatcataggtctccttatttatgaagtattctggtaattccgactgaaagtcctctttttcttcttcattctcgtgttatttatttatatctttttcatcgcacttagccttttcactcttggtcagctttctgttcagtgttcagggaatacatgaagattctctgaacccgcgacaaggaatgctgtagcttggaatagtctttctaagtccagaggctgctttcttcaactgtgtgtgcctttcacaagtttccaacttctattcggagccagccagtgctgtgtctactggtacaaaacatagtgttgtaaggctacacgtggaaatgcgcttaaactagaagcaataacagacataggttagtgtaagttatattttttctgtgagttttgaattttgttttcacttttatatttctgcaaatggaagatggcaaaagggctgtaaagaagtgaagatcagtaactgcctcaaatttcaaggcaagaaaaggcagattgttagaaatatccatctgattgaggaaaagtgacatgtttgcttgaggtatgtgtgtaatagattccactgaccactgcacggaatatgtgcagacacagctgatgctgcaaccttatcttaaaaactcatcctttaaaaaataatttccgcatcacaaatatgctttttctttatttcttctcataccattttaccgcctagttaccaatttgctgaaaacgtagtttcacaagaatcctgatttgcagagcacaggtttccttagctcgaggctgtatatatgttctgaaatggaaataaagtctctttcaatgattggattcagtggagctgggtttactgtaaagggaactttaatagctatttttcaatgaacacagaccatctccttttgattaagtttaactattaatgtaatttgacaaggaggtgagaagctcatgcctcatcttcatctgctgtctaaagtaacttaagcaaaagcaaagaaaagaagcagtaaggtgttgctgctggaaaattctgtctgaaaatgctgttatttgaaattatttatagagaattcactgaagtgaactatttcaataatatttttatgttaacgaaggttatcaatgataagatgagccaattataatagtctattataatttaaaatgaatcactggttatcttttcaacacattttatgtccaggagagcagcatatctgcagtgcttaagtgtgcagtctctgaaggcaggtgggaggtttgaattcagtctctagggtccgtacttctgtgaccttgggtggcacagaaggcttatcctttgtctaagccctgacttcctcaatagtaaaacagggataataattctacttacctcaaagttaatactctataggctggacacggtggctcacgcctgtaatcacagcactttgggaggccgaggtgagcagataacctgaggtcagaagttcaagcccagcctggctgacatggtgaaaccccatctctactaaaaatacaaaaattatccaggcatggtggcacgtgcttgtaatcccagctactcgggaggctgaggcagtagaattgcttgaacccgggaggcggagcttgaagtgagccgagatggcgccactgcactccagcctgggtgacagagcgatatttagtctcaaaaaacatttttttaaaaagttaatactctataaattttagctcttattatttatttattgttaagaaaatactcaacattttgaaggaaatgattatatctttcaacattcttgtgacttttctggatatctgctgatttgatgcatttttaaaaatcaaaatatgtaacatgtttttaccttattaatctagcataccatttaaatatacaacagtgtttcttctcttgactaataagtgaacgataatgataattcaacaactacatgatttattatctgatctgaggtttaactttaaatgccaacatcatttttaaggtattttaaaatagactttatttttaaagcagttttgtgttcatagcaaaattgagcagaaaatagagttccaatatatccccacctccaaacattcatagcctcccaactgatagcattttccttgaaagtttaatgattgagggttgcctgcttttacataatttactacgtattttttaaaaattataggccaggcgtggtggctcacgcctgcaatcccagcactttgggaggctgaggcgggtggatcacctaaggtcaggagttcaagaccagcctgggcaacacagtgaaaccccgtctctactaaaaacacaaaaattagccaggcatggtggcgctgcctgtaatcccagctactcgggggactgaggcaggggaatcgcttgaaccttggaggcggaggttgcagtgagccgagaatgcgccagcctgggtgacagagcaagactccatctcaaaagtaaataaataaataaataaataaataaataataaaataaataaaattatgttaatagatgttactatacatgttctggttaaaaacctgagaaagtattttattacatttgaggaatggatttgagagtatttgtacttcaggcaataagaaatattgatcaaatctaaaaaaaaggatcataaaaaagcatttgatactttgtttatccatatatttgcgaacataaatggagttttttggatcagatgacatagtatctatttccttaatctatgggttagaatataaaatgtgattgattacaaaataacttgtttttcatgaaaaaaattagcagctcttgtaaaatgcatctgaataaggagaaagtgtgctacaaatgagtaaagaaaaacgctgactggctatacaaatacactactcattagcacacaaaaactgtctcacttaaccagggaactccttccattccatcaggcatgccttccagagcacgttcttgccttttaaatcatcaatcattgctgccactttagtgagaccaaaagggttaaaactgaaacccagccattccctttcacttctgcaaatgcagctcagctttcccttctctggtctataacaaatgccacccactctttcctctggggtcttctctgatttgtatggccagtccccaacccgcctcctgaacttccatgcaacaatttcagaccctcagcagtggaaagtcttagcatagatgttctgtgagcttcagggcttaacccctcatgaaacttgacctgaatccgtcagtggatagaaaacggatttcatatttagaatcagcataactatttgttacaattttccagagtgtttttttttttctttggagactgagcctcgctctgtccagcccaggctggaatgcagtggtgtgatctccgctcactgcaacctctgcctccaggattcaagcaattctctgcctgagcctcctgagtatctgggattacaggtgtccgccaccatgcccggctaatttttttgtatttttagtagagatggagtttcaccatgttggccaggctggtctcgaactcctgacctcaggtgatccacccactttggcctcccaaagtgctggaattacaggcatgagccactgtgcccagcctctcaatattcttgatattatatgtacttgtattttctttgtatttgaaattatcattaggatggtaatcagacaacttagatgttacaatatctatactaatcacatcacattactttattgttactagtttctgtgaatgtgtcttatcttttaaattaaatccaaagctctttgagccagaaactttgtcttgtatgaggtttgctatataagtatttggagggaaaattgagtgactcgttctttcgtaaaactgttatatcggaacaccacagcttcatgaaaacacattaactagaagttattacactggagttcgatctccaaataatgcgggttgattaagttccattagctctgtggctttaagcaagttccctacttctcaagaccttattgaattcactttacaatagggtgactgggtcaggtgatgtctccagtattctcccttttaaagttatatcacttttcaaaaagaaagtctattctaagaaagaaaatatgactcgaagtctgaatttgcccaagtaccaaagaaaggctaaagttaaagcaaatcttattcatagagagcactagtaaatctatttctttttgatgcttgaatgttttctatgctggaatgttcttggtacatattaggttataaaatgactcatctttaggacatttcagtgcctgagggtattttctttgtaatccatgtattgaaatttgactcttgatagcacatgccaagcacatagttccataatatgattttttaaaattacagataatgaatatcagatgaacacaacagaagacacttagaaataaatcacattttgaccacttttaacaaatactcttagatcagtgtcagatatgagtccttaaagtttggccacaaagataataaacactttatcaaatctctatcttcataatgtgtgctcttctgaagaattattgtctctaacaatgctctcaaagagctaccagaaaggttattaaaatgaaacctatggtcactgtagtcagaatacaaaacaaacacgcatagtcacagttcatttgcatccatttgcacagtgcatttgtttgattttacaaataactgatagatgagtggaaataatattcaatgtcttgcaatttgcagaaaagagaagtgcgactttaatctcagaagaaaatatttcccagagaatgtgaatatctagtatattgtgctatcaaaactctatccctttattttatgtccttgcttgacatttagttggggtttattcaaggattacttgattggaaaagtgcctgcatatttggatgtttaaatacatttgatttatgtctcaagtgacatttgtggaaaacattttctgttttagaaacagtcagggtcagggaggtctcgccgaggggaggcagggactcaaatgaaggactggccacatggagtatgtgtatctcggagaagaacattgctgacctctgtaggaagaaagactggccacatggagcatgtgtatcttggagaagaacattgctgacctctgtaggaagaaagatgtgcacaggtgggtctggtctatgccacatggatcccagtaacagcaaggaggccaatgtaacaggggtagagaagcaaaggagacatttggagaggctgccatattttaaaggttttgtggccatgtttagatttggttataagagtcataggacaccattggtcttctgttttaaagacacctctcgctgctatagtgggaggaaggagaaatattagcatcaggtacaggtgaaccatgtttgtgtctgaggtagatgcccagcaagatgagatgtgcaaggtccatctacataactgtgaaggacaaagggaacgggggcagaggcagggaggggaagccttcagacagttgtgccagtgggagaccttgaaaggagaggtgagctcggacagcctgagacccagcatagtgctgaggaggtgctggcaaggccaatgggggccgcctgggaaaagctgctctctagaagaatcctgttccaggcatgaatagccttgacctagtcctctctcctaggactgggaagagcctgggagagggtggcctggtagtcaggaaagagtggcagctggggactgtcacctgcctgctccttgcagcaggttcttgtgaagggagagccaatcaggcacctccatgggcaccagaacgtgagcgctttggactagggtggaggtagtggaggtggtgaggttttgccggggttctaatatatttaaaggggagaaccaatgatatttactaaaaaataaaatgtgaaatgtcagaattctttgagttgagattttgggtgaatggttatgacaattcctaatggaaattggaaaatatttggaaggaatgggtgtcaaggtcagataaaggcagataagaaactgtttcaggcatgttaagtctgatttaactattcaccatccacttcgatatgtgacaatggcagctggatatattttactgggcggatggtggcctgtggtattccttcagctgccattgatggatagatggcttgtagagcgtgaagaccatcgaggagcggagtacagctgaggaagagaacggggtacattcacgacaccccagtgctccgcagcatctagaaattgggataagaaaatggatctagcgagagagtagaagtagccaggtagaagaataagtagtttatataaaaagagagtgtctgactcagaaaataagtaatgcagatgaaaaggaggggatcgatttgagaaacatctacttaggattggattatgaagtaaagaaaggactttaagaaggaggcagttgtcacttgcttcaaatcctgacaagaggtggaaaggatgatacctcaaatggatcactggatttagcagtgtggaggtcggtggtaatgctgacaaaagtggtttcagtggaacactgatgaaagcattattggagggaatgtaagacagaataagagagcaagtaaaggcagtgagcatagaaactactcagaggaaatcggctgtaacaagaaacaagatggagaattgctgtcctctcaagagagaggcttatgttttaagagagtgacaacacagcaagcttaaatgtttgtgggaaggctctcttagagaaggcaaaaacgtatgatccaggaggaaaaggggagaagcacatgggaaaattcttagaggaatcaataagaggggatgggatctactccatgtgaaatcagttttgctttagagacagcataagtaggtcacctgttttaccaggaggagaggcaaagcgcacaggtccagtgcagctgaagtggtttcctcgctagtggaaatttgtagacattctcttctgattgctttcaaacttctcagtgaaataaggatcaagtcacagttaggcaaagaggtgcggggcgggcatggtggagagttgagaaggggtggtgtgaaagtcactttggtggagggagagtaaatgaacttaatgactcttgtgacactgttgggcagtcctgagtgcctgcttgagttcattcctgtatatttaacgtgaggccaaccagcaggtttaatgtttttctgtattcatttccaagtccttgggtgtgagcacaaacaggcacaggccatatgtaatcattgtggtggttttactaggcagatgtggcacaggaaaaagggcaaggtaatcgagagtaaatagaagggggtggtgacaatgactgatgtaagattgacgctgggaaatgaaggaactgagagctggaggggtgcaattaatagagtgcgggctttgtgggttcaaaatatttagaatgggggccaaaacgctgaaggagacagcaagaaaagattatggaggagacagagtgagtctggatatgaaaaaaagtccagcgtgttatcacaagagacaaactggaagaggctagatgagcagaatagaggacaaagaaccaagagtcctgggtattggtaaaacctgctgtggtctggatgcttgtgtccctctagattcctatgttgaaaccctcatctccaaggtgatggcattaggaggcggggccttttgggatgcgacgggatcatgagggcagaacccttgtgagtgaagttcatgccttatacaagaaagcctagggccttctttcctctccaccgtgaggatgcagtgtgcagtgaactaggtagcgggctgtcaccagacaccacacctgccggcacctggatctcaaactctccagcctccagaactgtgaggaagacattactgttgttcataaaccacccaatctacagtattttgctacagcagccaaaatggacgaagacagatcatttacacgggtagaaaaatcaccaggaatagcgatggtgagaaaaacagcaagccagacacaagaatcacccgtgatgaaggggatggtaaatgactagggagagtgacagaaggcccagtcccctgacatgagccttgatggaactggagcttttagcaggaaccagggcaaatgggcttgaggcagcccagtagtgtgcagggtgtgaaagggaaaaacagccctcagttgacagtgtagtactttcctaggacttctgtagcaaaacaccatgcacttaatgccttcaatcaacaaacatttattctctcacaattatggaagccagaagtctgcagtcagtatcaatgggccaaaatcagggtgtcagcactgtcaccctcccttggtggctccataaggaaaccggttccttgtctctcagcttctggtgactgccagcattcattggcttgtggccacatcactccaatatttagggtcaacattttttgatctccctctgctctgtcttcatatctctttctcctctgtgtgccctaaaatctccctcctcatctcgtaacagaatatgtgtgatgtgtgattgcattcagggtccatctgaacaatccaggacgatctccccatcttgagaacataatcatatctgcaaaggctttcttttcttgccatatgttatggtcacctgcaaagacatatgggcccctgaggtttgatttgaatgttgaggctgatgatgccacacacaagctaagggggtatgaaaggttcattactcacatacttcaggcttctggggagagcaggtgggcctcacaagcagatccaatgtgacctaagaaagcaagggaagaagactggcccaagatgttatagtggttaggggtggggctggggtggggtcaaagttcccatgtgtgggaagggctcgtatggtttgactcccccaccagtgccaagggagggggctccccatctttcctgttggcttatccagatgcgggcataaaggaataccaaggggtgaggcctagaagctgtcaggagtcaaacatcaagaaatggggccagtctgggcctggtggctcatgcctataatcctagctgggaagctgaggcccagaactttgggaggcccagcacttgaggccaggagtctgagaccagcctggccaacatggtgaaaccctgtctctaccaaaatataaaagttagccaggggtggcggcacatgcctgtagtctgtaatcccagttacttgggaggctgaggcagaagaatcacttgagctcaggaggcagaggttgcagtgagccgagctcacaccactgcactccagcctgggtgacagagtgagacccttcctcaaaaaaaaaaaaaaaaaaaaaaaaaaaaaaaaaaaaaagggagggaggccagactactcattacatcatataaggcaattttcccaggttctaaggttctagagattaggaactggctatcctggggtgggtggtagagtccagcctaccacagggagttatgaaacataagcatggtcctcaagggggaactgagattagggttcgatcagaaataggaggggcgtatgaaagaagtcagtgctatagatttttatgtagttaccaatgagctgaaacccatttccccattttatctgttttgttcattgctgtgttctcagcttctacaacagtacttggaacatagttggcatttgataaatattttctaaataaataaatgaataaaaatggacgacatttctaatgtaaagaagttattggaaaatcacaatggaaagttggatttgaaatttaggcatcttcacaaagttcatatgcattattactttaaaattctgtagcgtggaagggagatggcaggggagtatgtcactttgtgacacaaatgaatgaaccatgctaatttcatggaaaaccctatctaaaattctgaaacagaacaccctgcctcccacctgacatagctgcttctgttagcgttttccagccctgtgtctccatgcagaacaaccccaaccgcctgctctgttgtgggtcaacacgctgcctttccaagcactctgaatacaccacagacgtgtcctacccacaaacgtcttcctggtggcgccccttcaaatctaggatctacaatatggaaagaaaattttatttaagtagctgttcataagacactaactgaaagatgtgcgcgcgtgcacacacacacacacacacacgatgtacagtgtcacagaggctctagctatggttattggacttccgaaggatgcagaaggagaaagagagtgataattaaccattacgttagagcaaaacccaagatggttcctgcacgttgattttctacagtgattaactttttttttcttttgtttttgagacggagtctcgctttgtgtcccaggctggagtgcagtggtgcgatcttggctcactgcaacctctgcctcccaggttcaagcaattctactgcctcagcctccctagaagctgggatcccaggtgcctgccaccacacctggctaagttttgtatttctagtagagaaggggtttcaccatgttggccaggctggtcttgaactcctgacctcaggtgatcctttggcctcccaaagtgctgggattacaggcgtgagccactatgcccagcccctctactgcataacttaattaccacaaaataatgcactagatcttcatatttcctcccacggggcactcattcaccaagggactcatttccaaggtctttcaccctatttcttttcttttgaaaaatattcagggaatgagagtttaatataaattgtcattagccaatattcttagccagtcccacacctttaagatggcccgtcttgacgtcttgttcaatggttgccaagccggcaagtgagcatgcacatcctcttggatttcgtccccaaatacaagaggaaagaaacaacgtctcccactgtgaaggatggtggcatcgttagtgggagggtgtccactatatctgtcttcttctactgccctgtattttctcatatcacagcttgacctctctaaatctgatggaaggagaaagactgaagtcagagaggcttgtatctgatggaaggagaaagactgaagtcagagaggcatgtacggagctttgagttttattgtttgacacgcaagggtctgatacttttgtttctggtctcctgtcagggtgccactgacagggccttacactctgctgaatgtagcccgtagccctttggtgagcaccttggcctgcacagaaggcccctgtgctcagcagagtcttcagggagaaattcacttctgggttttctcggcgcctgagaatcctcttcaaggtctcagtcttccatctctagtcctgctctgccctctctctgagttcactaagattgtggatcttctaggttttcacaatggacttttccttctcattttgccctgctctgtgctttgtacttgtgcagcatgcagttgtctgagccctgtgcagagtctcaactcccagccctcttgtttacctagcattgtgaatgcacactgtgattctgggtggcatttctctggagctgtgcattccaggattccggtcaagagagaaataatgctcacatgcttcctcggaggactaggactgaccccgctgcatgcatctgaagaggtaatggtccctacagtgtggtcctttttgggcaaggcttgttaatatctgctctttcattactgtgtagtagggcaaagtcactgcaaatggccgtttcccggtttctaatgtcctgcttttcctagccccctaaggtactttgaccactggttatgaacaaggctgttggctattctattttcaaacagcagtcgtctgttaggaataactatcaatttaatggcgccaatggccatcaaaacaaagaaaattacacagtaagtctgtctttctttctcgaagggaatcatttgcatctcactgtggtaccaagtgtcgccgtttccctcaacatgctggtaaccatcagtcccacaacagagtgaaccaagaatgcagagggctttttgtgctcaatatctttgctttggccaaggaaacactttccataatatcacgtttacttttttaacttttatagtacagagtgaaacatgtagaaaatagtagctgtctcgaaagagatgggaagactaagcctagtgatgaatgaggcacacatagaaagggacaggtgcaccaggacatgggtggggatggtccctgctccatagaaagggacaggtgcaccaggacacgggtggggatggtccctgctcctcatgtctgtgcgaggctttcatttgcaggcttcacagtgctttagaataatgtgttcatggaataaagagaaaggtagcatgggaggaaaatgttttcatacaaagcgaggaaattaaatatcacttgattcaactgggtattttaaggggaaaattacatgattaaatcacacccatggaagtttggtttagaattccattatctaagatggatgaacatttccaaggccctaaactgtgtattagaaagaaatcctaattgcatcaaaataaatgaaatgttatatttttgttattagtttttgagtgcctttcaacccagaagaaaactaaacttgatttaaaaaaaaaaaagctttataacaagatgttagaggtgataaatttaaagtttgaataggaagagcatggtctgggactagaaacactgtaggacagagatgttcctttccacctatttagttattcatttaataacaggctacaggtatcacctatttttttttttttttttgaaactgagtctcagtctctcgcccaggctggagttcagtggtgcaatctaggctcactgcaacctccacctcctgggttcaagcaattctctgcctcagctgggattacaggcgcccgtcaccacacccagctaatttttttgtatttttagtggagacgggttttcaccatcttggccaagctggtcctgaactcctgacctcgtgatccacccgccgcgtcttcccaaagtgctgggattacaggcatgagccaccgctcacggccctatcatccattcttgattgcacatcctcttttggcttccgtgaaagcatactgctatgttttatttctgcctctcttgttacccgccgttatcaatcctaggctcctttctcccatgctcctgcctctatatggtgttgctgaggtccacctttcctctctcatccatcactaaggttgctagaagatccttgttctcagggtgtcactcacacacatgactctcaaatcaaagtagccagcagaacctccacgctgtgatccaatctagaatttccaagctgtcttctggatatttctttttgaatatttgaaccaacagtactgtactttaactcttcctctgctttcttcccaaggctcctagcttctgtgttatcatttgtgacttttccattaagaaaaaatctgttacgagttatttcacctaaaacacggcacattattattttttaatttgtaataattgtgtctgtagtcttaaaagtacaatgctatctcagaatcatataggtatcttttttttttctttttttttgagatggagtcatgctctgttgcccaggctggagtgcagtggcacaatctcggctcactgcaaccttctactctctggttcaagcgattctcctgcctcagcctgccaagtagctgggattacaggcacacatgccaccacgcccagctaatttctgtatttttaatagagacggggtttcaccatgttggccaggatggtgtcaatctcctgacctagtgattcacctgctgggcctccccaaagtgctgggattacaggcatgagccactgtgcccagctgggatctcgttaaagacacagaccccaattaagattggggaatcagagcctttggagacttgggaactcgtgctgtactcatgacttcacgtggttctcatacacactaaggtgagagaaccataaccctggacagcagagaggatactttttgttaattaaatgccacactttatttcaagatattagattaggtattattgacagctgtttgcaaaacccaggaaggcattttatcaatagctactattcattttcagtttgcttcattccaacttgctgtgtattttagttgctctttcggtttaaagcaaatgaaccaactctgactagatttaaacaaaaagcgaatctaagcgaacctattgggagaacactaggttatctcatggagatgtggtaaagtagagaatagggagggactagatcaactccaggtaccttggcagtgaaacctcgtggatcttctcgccactgaatttccttcagttggactttggctcctgtcacttgcaacctgtacttccacccctgctcccaaatttaattttattttttaaaattgcttttaaatgacatgtaataattgtacatatttcggaatacaaagagatatttccatacatggatgtaatgtataattaccatattgtggtaattagcatatctatcatgtataacacaaagaatttatcatttctttgtgttgggaatattcaaaatcctcttttctagctatttgaaaatacacaataaattattgttaactatcatcacccttacagggctatagaaactagagctgactcctatccagttgtaattttgtatctctccttatccttctctcctcctatagtctccaactgacagtaaccataactctactctctgcttctagagctcaatgttttagctcccatacatgggtgagaacatgcggtatttatctttttgtgtctgacttatttcatttaacataatgtcctccaggctcatccttgttgctgtgagtgacaagacttcattcttttttatgacagaatagtatatcattgtgtgtagttaccacactttatccactcatctgatgatagactcttaggctgactccatatcttggctattgtggatagtgcttcagtagacatgggagtgcagatatctctttgagatactgattttctttcttttggatgaatagcgagtagagggattgctagatcatatggtagttctattcttagtttttcgaggaaactccatacggtttttcataatggccatactaatttacaatcccaccaacagtatgtaggagctcccttttctctgcatcctcaccagcatctgttatttttgtcttgttgatagtagccattttaactgggacaagagaatatctcattgtggttttgatttgcatttccataatgattagtgacgtcattttttaaaatgttctttttgcccatttgtatgtccttttttgagaaatgtctttcagattctttggccactgtaaaatcagatttttttttgcttttttatttttttgctgttgtttgaattccttgtatattctgagcattaatctcttgttggatgaatagttcgcaaatattttctcccatcctaaagtggtctttctattctgttgattacttcctttgctgtgcataaggtttttagtttgatatagtctcatttgtctatttttacgtttgttgcttgtacttgtaaagtcttacctataaaagcttcacccagtctcaagtcctaaagtgtttcccccatgttgtcttctaggaattgtatagttttgggtcttaaacttaagtctttaatccattttgaatttattttcatgtatggtgtgagagagagagagagaggtctagatttattcttctgcatatgcatatccacttttcaacgtttttggtgactttgtcaaaaagtcaggtgactgtaaataagagaatttatttatgggttttctagtctgttccattggtttatgtgtctgcttttataccagtgtcatgctgttttgattactagagctttgtagtatattttgaggacaggtagtataatacttccagctttgttctttgtgcttagaattgcattagctattcagggtattttgtggttccatacaagatttggaatattttttctatttctgtgaggaatatcattggtattttgatagtgaaaccagtccagtagtcccatagatagcttttttttggataaacatagaatttgatccttctgttcttaaagcttgaagcttgcatttgttttatctgtgttccttcctcaggatgacattcagggctctcaaaaaaagtatcaaagaggccgggcgcagtggctcacgcctgtaatcccagcactttgggaggccgaggcgggcggatcacgaggtcaggagatcgagaccatcctggctaacatggtgaaaccccgtctctactaaaaatacaaaaaattagctgggcgaggtggcgggtgcccatagtcccagctactcaggaggctgaggcaggagaatggcgaaaacccggggggggggagcctgcagtgagcagagatcgcaccactgcactccagcctgggtgacagagtgagactccgtctcaaaaaaagtatcaaagaactgaaactcacctgatcaccacatccagacaatgagatgccaaacccctcattcatcatgattactttcttgctcctccctagttcctcccttttcttagacattgtcacatttcttccctgctatataaaccactagttatagccagtcagggaaatggatttgatactaatctcccatctcctttgctgcagcactccgttaaatccttcttccttggcaatactcattgtttcagtgactggctttctgtgtggcaagcagcaggacctagactgaacccctgtgctttggtagcaacaggaattgcactaaatctgtagcttgctttgattaagatggtcattttaacaatattgactgttccaatctgaacatggaatttttcttttttggtgggtgtgtccttttcaatttttctcatcggtgttttgtagttttcattgtagaggtcttttatctccttggttaaatttatttctaggtactttatttttttgtagctattaaaaatgggattgcttttttgatttcttcagctagtttgttattggtatatagacttgctattaattcttatatgttgattttatattctgcaactttaccaaattcactgatcagttccaagaattctgtggtgaagtctttaggtttttctctatataagattatgtcatctgcaaagagggacaatttgattttctcttttccaattttgctgtattgtattgctttctcttgcttaactgccctggctaggaattccagtacagtgttgaataagagtagtgaaaatgggcgttcttgtctggttccagctcctagaggaaaagtttttccccattcagtatgctgtcagctgtgggtttgttacatacggcctttattattttgaggtacactccttccatgcctaatttattgagaattttttgtcatgaagggatgttgagttttatcaggtgctttttctgtatctattgagatgatcctatggcttttgcccttaattccgttgatgtgatgtatcacatttattgatttgggtataccaaaacatccttgcgtttttaggactaatcccatttgaacatgggtgtataatttttttgatgtgctgttagattcagtttgctggtattttgttcaggatttttgcatttaggtgcatcagggatactgatctgtagttttgtcgctattgcttttgtgtcctggtctggtttgggtagcagagtaatgctggtctgctagaagaagtttggaaatgatcccttctcttccatttttttgaagagcttgtgtcaaattggtattagttctttaaatctttgggagaattcagcagtggagccaccaggtcctgggcttttctttgatgggagactttttatgatggcttcaatcatattgcccattattggtttgttgaggttttctttttcttcatggtttcatgttggtaggttgtatgtgtgcagggatttattcatttcttctagtttttcctatttgctggtggatagttgttcataatagtctctaatgattgtttgtatttctgtggtctcagttgttagtcttcttttttgtttctgattttatttatttgggtcttctctctcttctcttagtttagctaacagtttatcaatttttgtttgtcttttcaaaaaggcaagttttcatttcatcgatcttttgtaatttttttttagtctctactatgtttagttctgctctgatctttatttatttattttctagtttaaaattttgggtttagtttgttcttcctttactagttcattgatgtgcattgttagattgtttatttgaaatctttctacttttttaaagcaggcatttatttctataaatttattcctggggatcaacttacctctttctgtgtggtgaggagtgtctcttgggatgagccgatcccagccaggctcttcactttcctctttatgctgccatctccagtctctgtgcatcagaaggtctttatcactttcttgctgaattccagtgttttctcctatacactctatttgatgtgttgttttctaattgttttggtcctttgtggagtaggagagcactgggcatctcttatcagccttcttgatgacatctggataggacaatattgatcaatgatatatctagaagcaattttgaataaataatatagtgttataggttataattaaatatgtaaaccaaaaataaataaaggaaaggaagaaaaacctccctttttttcagaggcagggagtttttatttttggcttctgtaatggtatttcaccaagttttaaaggtattaactttattaacccgcaacattcatcattttaaaggcgtatatagaaactatcaaaatgggtcagaaacaaggtttgcgatactcataattatcttcaacagtggcaatatttaaccttttgagtcaatctcaacagattggcaatataacataatatatattgataagtgtcattcttgataaaaaatcaaattatttttctatttacaatttttagaaaaggtttaatgtaaaaatatttttcttctttatatatttccctgccatgataatgttaaaacatatcaagatgctcctcaaagtttaggagtgaacagcataacattccattttagttgaagcattctttcacatagccaacatattttttcaagacactctaagaactcgtgaggatactacaggaaaaatgttcctcttgcctactgagcttttagtcatattttccctcaaacttttctaaattaaacattgttataactgggtttgtttttttttttgaaatttaattttccacggtgcagtcctcaagttattcttttattcggagccactccttcagtttcaacttgctgagcaggcaagcaactgcttttggtttctatggaaactggattcctgtggctgcctgtaggtattctcgttccaccaaccttttgttgtgttgtggtatccagtgatttaggtggaaaagtacaagttattcttccatgatggatatgatatggtcataacaggctaggatctaatcggacccagagaactgagagactggaaggtacatcaggaaggctgcaatgtgttttatacaaattgtatgctgtcctagtaacttttccatcagaggtcttatggattgggagtgaagaatcttctgctgcctgagataacaagtaggaaccctcctgccagctacttaatttctttagaatgtgttggagaatgttaaatacattggaaatcttgagtgctgaaagcttttcttttaatgcttctgaggtaatttcttccagtagaaaaagctttgaagtaaatgcatcgatatggccaatgtaaaatatctgttggaatgcaatcaacttccagtccacaagcgacaacgttcactttcagtcagagcttcaactccataaccagcttgattctctacttctggtagtacataaactggaaattgttttccgattttcttctgtttcttagaacgtggtcttgtctccatcctccggacactgcagcacatgagtaacaacaggtcttgcaggctaaataacttatgaataaagtttccttcctgaggagctaggtattccgacgtatcttcaacatagtcctgaagttcatatggcaatcgtccttttggcttctgaaatgcagaaggccatccaatttcggccaactagaggcatctgaagggacagaccgttgctcagaaacagagggctgtttagaattttctaaattcattaagggcaatttgggtacttttctggaaattggctttaagagctcatcctgcattttaaaaatttctccaacaggatcaaattttttatatactcatttgataggtttttttaaaaaaaaatacatgacttgccaggcgtggtggctcacgcttgtaatcccaacacttcgggaggctgaggaaggtggatcacctgacgtcaggagttcgagaccagcctgaccaatgtggagaaagcccatctctactaaaaatacaaaaaaaaaaaaaaaaatggctgggtgtggtggcgcatgcctgtaatcccagctacttgagaggctgaggcaggagaattgcttgaacctgggaggcagaggttgcagtgagctgagatcgtgccactgcactccagcctggggcaacaagaaagaaactccgcctcaaaaaaaattaaataaataaaaagtaaaaaaataaaaacacatgactcttctggactacaagcagtattagtctggttttctgcagaagcctgtcctgaggaagaatttgggctagctggtcaagaatttaagttggaacccatgacagctgtctttccgtcactattatttttacactctgtatcaataattaaacactccttatctgtatcactgctgcagagaactgtatcttcagttttagctgcttctgatgtcacagtcttttcctttgagttgtctaggttttccagaacattgggtctttcagcatcaacatgtaccatatctatagtcatatcatatttattagcagtttcaatttcctgagaattttctaactgtaaggcatcagatgttttcaagtcactatcttgcctcgaagacttgtcagtatttgatacctttttgccacatgattcaaatccctggtcatctttatttttgcactctttagggccaccatccataccagtgaccagttgtttctccttttgcgactgttcaatgagaatctgagataaacttctagaattagcagaaatgtctggtgcacttggtgccacaggtgtagttcctgctttgggggctgtaggagcatctgtcacgttagttactgtggaagtacttgctggacttcttggctttgatgctttggtggtggttactccaaaagtttcaagttttgtaacatcaccatcaaaatccagatacaagttttcaagagtctcagtgttttggcactcactacttcacagggcatgtccatttcagatataaactcttcaaggataaacctcttttctatgcctggtgggagagtcaaagatccctgttcttaaggatgtaaatatatacacagataatatagttattgaataacttgggtttgagggaagtaaaaatagttgttttctagcataaaagtaattcctttttcaaagcttcaaattaattttggatcagtgggaggatcatttttaaacttaataaatgagtgaaagtccagttaaaacagaagaataagaacagttcattttaagtagactctcacaagcttggtcaaatcaaatgctctaggaccttctcgtatattttaggatactttacttgtatttgggagatgattccccaggagtatttcatatattcacatgtggtgtaaacagagactctggcagcttttctttcaaatgatcttttcaaggatattgccattgtgaacagctttggaagttaaggtagcttttccctctgtggtagagggcaggttttcttggtgtttaggaaaattaaaataatgactacttttaggacaaagtttgagcaaacttacttgaggtctgatatggtttggctgtgacctcacccaaatctcatcttgaattgtagctcccacaattcccatgtgttgtgggagatacctggtgggagttaattgaatcatgggggtaggcctttcccatgctattctcgtgatagtgaataggtctcatgagatctagcggtttcacaaaggggagtttccctgcacaagttctcttttcttgtctgccgccatgtgagatgtgccttttacttccagccatgattgtgaggcctccccagccatgtggaactgtaagtccattaaaactctttcttttgtatatgcccagtctcaggtgtgtctttatcagcagcatgaaaacagactaatacaaggtccattataaatgactggagtttcctaagctccagcttccatagctatgaagaaaatccactcagtatacaacttttcccttttttagcctaggagtcttgtgtcttttgccaacatccatgaaacaatgataatgtaactcattagattgcaagtagagtaaacctcagaccctttacaattaagtgtttctccacagtttacatgaaattgaaaaatgaaggcaccaagaatttgtttttttctccttacacacacatctgggcttttacaattgtagggaccagccccacagggtcggagggtttttctccccgtgtgcggagatgagacattgtagaaataaagacacaagacaaagagataaaagaaaagacagctgggcctgggggaccactaccaccaagatgcggagaccggtagtggccctgaatgcctggctgcgctgttatttattggatacaaggcaaaaggggcagggtaaggagtgtgagtcatctctaatgattgacaaggtcacatgagtcatgtgtccactggacagggggcccttccctgtttggcagccgaggtggagagacagagagagagagaggacacagcctacgccattatttcttcatatcagaggtttttagtactttcactaattttgctacggctatctagaaggcagagccaggtgtacaggatggaacataaaagtggactaggagtgtgaccactaaagcacagcatcacagggagatggttaggcctccagataactgtgggcaggcctgactgatgtcaggccctccactagaggtggaggagtagagtcttctctaaactccaccagggaaagggagactccctttcccagtctgctaagtagtgggtgtttttccttggcactgacgctaccgctagaccacagtccacttggcaacgggcgtcttcccagacgctggcgttatcactagaccaaggagccctctggtggccctgtctgggcgtgacagaaggctcgcattcttgtcttctggtcacttctcactatgtcctgtctctgtatggcctagtttttcctaggttatgatcatagagcaaggattattataatattggaataaagagtaattgctacaaactaatgattaatgatattcatatataatcatatctatgatctatatctagtataactattcttattttatatattttattatactggaacagcttgttgccttggtctcttgcctcggcacctgggtggcttgccgcccacatgcaatagctttctagctatttcttctgtagcatataagagttcagcaaacatttactgggtcccaatcttgtaacagatactcttatagatcctagaaatcccaagataaataaaacatgattcttgacccaaaatgcttccaatgaatagaagaaacaatgcataaagacgcatgacacagaaacagtatttttccttccttctttccttccttccttccttcctttctttttctttcttagattgggtctcactccgtcacccaggataaagtgcagtggcacagtcttggctcgctgcaacctccgactcctgagttcaagtgattctcctgccttagcctcctgagtagctgggattacagccgtgcaccaccacgcccggccaatttttttgtatttttagtagagacgggttttgccatgttggccagggtggtctccaactcctgacctcaggttatctgcctgccttggcctcccaaaatgctgggattacaggcgtgagccactgtgcctggcataaacagtatttttcatagcatgggatataagtgacgacagcaacagcaactttttttttttttgagatggagtcttgcttgttacccaggctggagagcagtggtgtgatctcggctcactgcaacctccacctcccaggttctagcgattctggttcctcagcttccccagtaactgggtttacaggcgcccgccaccatgtgccagctaatttttgtattttcagtagagatggggtttcaccatattgcccaggctggtctcaaactcctgacctcatgatccacctgccttggcctcccaaagtgctgggattacaggtgtgagccaccgcacccagccaatgacagcaacattcaaggggtgctctgagagcacactgaggtgcacttagcctgtcgtgaaagttcaagagatggttcttgaagttgatggtcactgaatgcggttttgcaggagattgaatttgaaaagctaccttaccttccgaggctgttcccagtgcaaatatccttgaaaagatcattcaaaaacatgtgaaaagagtgtttctgacggaaggacatatacagaaacataaaatagcatgatgtgaatcaaggaactaaacaccaactgctgttactagtttgtggagttccttgtgtggagcagtaggaagttgaagctggagtttgctatgcatgctgcgttaaggaactcagattttagcctttatgccagttgcctccagacttttttttttttttagatggagcctcgctctgttgcccaggctggagtccagtggtacaatctcggctcactggaacatccgcctcccaggttcaagcaattctctgcctctgcctccagagtagctaggactacaggcgcctgccaccatgcccagctaatttttgtatttttagtggaaacggggtttcaccctcttagccaggctgttcttgaactcctgacctcgtgatccacccacctcggcctcccaaagtgctgggattacaggcatgagtagctggccttaggcttttctgattatacatttatttagtaaaactttctcaagcagtcacctctaatatatctatatgtatttataaatttctctacacgttgtatggtctccccatatattaaatgttagtattttattttattttataaaacgaaataaaaatagataaagttggccaggcgaggtggctcacgactgtaatcccagcacttctggaggccgaggcgggtggatcacgaggtcaggagatggagaccatcctggcgaacacggtgaaaccccgtctccactgaaaatacaaacaaaaaaaaagaaaaaaggaaaaaaaaattagccgggcgtggtggcgggcgcctgtggtcccagctactcgggaggctgaggcaggagaatggcgtgaacccaggaggcagagccgcagtgagccgagattgtgcccctgcactacagcttgggcgaaagagcaagactccgtctcaaaaaaaaaaaaaatagataaagtttctcatattttcttctacacctcaactgattgtctttctcactctccttgagggccacatttagtctgcttgcaggtgctaacacggggaatgatgatttggtcagattcatgttttcaatcactcctcacagtggaagataagagttgagggatgcaggattcaaggagggaagtgtaggaaccaagatattatgatggatcaagcaagagaaagtcaggatctgactgagagagcaggcatggagtgaaaaggagggctaaatttgagaaatacctaggtagtagaattggtacgatccgcccattgagtaggggtggggagtggctctgagaggccggagtgaggcctgagtgaagggatgggagaagcaaatccattgagtagggatggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggccggactgaagggatgggagaagcaaatccattgagtaggggtggggagtggctctgagaggccagagtgaggcctgagtgaagggatgggagaagcaaatccattgagtaggggtggggagtggctctgagaggccggagtgaggccggactgaagggatgggagaagcaaatccattgagtaggggtggggagtggctctgagaggccggagtgaggcctgagtgaagggatgggagaagcaagtccattgagtaggggtggggagtggctctgagaggccggagtgaggccggactgaagggatgggagaagcaaatccattgagtaggggtggggagtggctctgagaggccggagtgaggcctgagtgaagggatgggagaagcaaatccattgagtaggggtggggagtggctctgagaggccagagtgaggccggactgaagggatgggagaagcaaatccattgagtaggggtggggagtggctctgagaggccggagtgaggccggactgaagggatgggagaagcaaatccattgagtaggggtggggagtggctctgagaggccggagcgaggcctgagtgaagggatgggagaagcaaatccattgagtaggggtggggagtggctctgagaggccggagcgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggaagggatgggagaagcaaatggcgcacattgtgtttcggtgactgagagaatagtggttatgtttaatgagacagaagattcagtggataagcagattttagtggtgggttcaattaagaaattgacctcatctttatacagattcacttccttttaattttctctcaacacactcatccaaaatttggttgtgttgtttttctgctgaacaacctgtattattctcctttcttttccaaatctccacattttggcccaacccgtgttccatggtgaattcagacagtaaaagaagcaactgtttttcaagtgccttctttgttatttataacacaatgctttttattccaattttgtagttgacttcttttctctaatagattattgtttagtcattgcagatcctgttattcttcccagcaaacaacctcaaagtttcactggcttacaataaataaaatttatttcttgcttgtgtaatttaattttatttcatgtacttttatcccaatgtacatttcaatttgggacccagaccaaaatagccattcaagtgcgaggggtttattttgtagatgatccgaaaagaataggaagtgagatagggaagaaaataatgacaaaaaaggctttattttcaagggcgttatcactgtggacaactggagcttaatcctactgcggaaaccgagaagccagggtaaaatgtgtacctgagtaatcccacccgtgggccaaggtaattgtaatatttacacaccaatttccatcagccattggtcgtggctgtacctatgagtgatcactttccagcatttcaggcctagaaaaagtagccaaggaggtttcagagtcagagaaagccctcgtgcagaaaatgtacatgctagcatttacaaatcagtcaggtatgcatcgatgtggttagagtaaaaggacatagagaggaatccactaaatccatccaggaataaacaaataaaataggaaaaaaaaacccactgttgacataagttaatacttttattttaccactatttctttctttagcccttttattcagttacggctacttgtgtacattaggtaggtagtgtgcaaattttacagtatgcattaactcaaattctatatttgtagtaactaaaacacgccttatttttcatctctatgctattccctcccctttccccagtttctctgtgtatgaagctcgactgacttgtcaaaagctccctaaagtgatgtttttacaataaagtctctcctaaacttcagttaggatcaatcactctctactggctgctcctgtagaattttatctgtagttttgttttgtcatcttatcactttataatattatttacaatctgtctgttaatgtattgtgcacagggctgggcgcagtggctcacacctgtaatcccagcactttgggaggctgaggtgggtggatcacgaggtcaggagttcaagaccatcctggttaacacgatgaaaccccgtctctactaaaaatacaaaaaattacccggcgtggtagcgggtgcctgtagtcccagctactcgagaggttgaggcaggagaaaagctcaccaggaggttgcagtaagccgagatcgcgccactgcactccagcctgggtgacagagcgagattttgtcttaaaaaaaaatatatatatatatatatacacacacacacacacacacacacacatatatatatagaacacctttaagatgatttgtgtcttacttctttttacttatcccatgattgtcacaataaaggtttgctcacatcataagcaaatacctaaatagacatgcctgattttcttacaattatggaagtgaatcttactttgaaaaaaaatcataaatgccccacatttttcaatgtgcttttggacatttcttaataactatgtttttataatattatatatgttaaggcacttacaattttaatgtgtagttatatgtaaaatcacattgtatcgagtaagcattatcaaataattctttatgatgaaattaatttatgagtttctaataaatactacagtattgttggccagaaagcactaatgaaaataaattaaaggtattgtttgttactttaaaggctaggaatttctaatataaagaaatgtaaggaatagttcataatttaagaacacagccacttcaaattgtaaaaaagaattatctattgttaaagcgaactaaatatggcctgggaaggactctatacttctatacttgagtccttgtagaggaaccataacctaacttaataggacaacaagattgaaaacctaatttaggagtatgtacgtggaacaatcgccagtccagcagccatacttcagccactcacacactgctgcgtgttcaaactgtgttcgagtaaggcaaacttgtaaccagtccagttgtttgtgtaactcacttccgatttctgtacatctttttcctttttttgtctacaaattttcttccacgatgtggctgtgctggagtctctctgaatctgctgcgattctgggagctgattcacgcatcattcattgctcaagtaaactcctttaaatttaattcagctggccgggtgcggtggctcacgcctgtaatcccagcactttgggagtctgaggagggcagatcacctgaggtcaggagttcgagaccagcctgaccaacatggtgaaactccatctctactaaaaatacaaaaattagccaggcgtggtggtgcgtgcctgtaatcccagctacttgggaggctgaggcaggagaatcgcttgaatccgggaggtggaggttgcagtgagcagatatcgtgccactacactccagcctgggcaacaaaagcaaaacccgtctcaaaaaacccaaaagtttaattctactgaagtttttctgttaacactgtgttattattttatcttttgatgaaaggcaaatgatataaacaagaacttggaatatttgtgaataatgtataaataaatagtttctgtttattctctgtattctgttaaaagtttttgctctgctcaatatatctggccataaaattcttttaaatcctgtataattttaaaagcaaatttgatgcatgtgcaacttattttattttattttttttgaggctgtttgttacaatggaaattgccttaacaagtctcatgtggcacatgtggtgcccagagcattctgaaagttatggttttgaaagcagtcgttgtggcgacattgtcctaattaaagttctcgggcagttttgccgacattcaaaaccatcttccatttttatccttttgtggtaatatttatcatttataaaaaggaattccaacacctcttttctatgtataatctcccaacgttcctggtcaaagcagtttgctcccaaattaccagaagtggtctcgttgcggcagcagagctcccctggtgcacttctactcacgggtttgttgaacgtgtagctttacccaccttgaggcagaactgcatgtgcccgtgttggcgctgacgcatgatgtgtggtgcacggatggagcaaaggtgaatatctccccacagcagacctccgaggttcataaattatttatcacatacttcagtgtgctgccacagtgatcagggccagtttccaatatggagacaagagctctttaatcacgctcttccctgcaaaagaaaaagattggcatttaacagagagctgtaagacaggatagggatgtgactgcagggaaacctccacttggaataggagtcgctggtcagttctagacccaatggcatggacttatgtagtaatagtagtaagagttcctgaagatagtttcaatctattgccagcattctgtaggtctttataacaagcaggaaatggatacacatgtctctgttccataattagaaaagtatcaccattttcctgggacaaaaatatgtaagtttaaacatttttagtgccaggtcagtagtcacgatttaccaacagcattttttattttaaaaatacagttagtgactacaccattggctaacaaactgagacttaaagcattctctagatgcaaatgctacaaataaatcaaattattaggcatattcactaatacttacaaacttaacttcatatataaagcaaggtagatcaccagtgtggccatgcaaacagggtttgaggacttcaatatttaaagcaagttagtccaacccacagcccaagggccacatgcagcccaggatggctttgaatgaggcccaacacaaattagcaaattactaaacttacttaaaatgatgggattttattttttgccattttttggtttgtgtgtttggtttttagctcatcagctttgttagtgttagtgtattttatgtgtggcccaagacaatacttccaatgtggcccagggaagccaaaagattggacactcctgatttaaagggaaaagggagggcagatgaagaaagaggataaaaaaaagagagagaaggtagacaaaacaggaaagtggttagtctttggaggctttgattagcacttactgaatctacattttacatgtgaaaggagtgggtagcgaaacagtgaattatgcatagtgctcagtgcgtctgcatttttgcataagataaagtaaacatagaggaggtgctcaaatatgcattcctctcaggtgagccaagggatgccctctaggcctgtctttgtcaaggtaccggtgaagataagctgttagtttacattgtcaaggtgaaatagaacagcgttctgttttagggtaaagctcttggggcccacgaggaatttccttgtgagcaatttgtgaaggaggccaccgggggagacatgtggccttctgtctttgcagctatctacttaggaacaaaatggaaggcagtttttgcatgatgcagttactgagcttcacttttccctttggcatagtgagtttggggtcctgagatttttatattcctttcacagcctcactatacttgaattaaaatacaatctacatgttaaaactgaccacatcattctttcctgtgtgtcttcaaaggatttaaggcccatccagataatccaagatgatctcatttcaaagccttaattatatctttgatgactctttttccaaataaggtctcaattagaggttcctggaataagacacggactcatctccctgggggccaccattcagcctgatccggaaggaaggccatgatttcagctctctgggatttgagacaaagaggccccttttctttcattttatcttttcatgtctcttcttgccatgtacccacatgattgagtgtgggctgagggtgaatccaagaagggctttgttttgtggtcagtacaggctttggtccacagagacaacaatactttcaatactcttttgttctgccccagaggagctcaacacagaattgcctagaacaagaaactgggtaagtgtgcttggaacatacgcttgtcttctcttctttggactcttgattgcaacactcatctctgcctggatattcacatggacttatactctctgtcttttcttctgtgtgtcttctcttctgtatgtcactgaatgttgggcccacctggataacccaagatgatctcatcttgaggtacttaattatatctgcaaataacattttcctaaataaggtcacaggcatagttttgggggactgggacatggatatatctttttggagaccatgatttaactcactataggctaaattctcagccctaaaaggggtcctacacaaagtgagggcactcaatggaaagaagggctctgagatgtgagataggaacatgtgaacagaaccttcaacccacagattcccctggactatcaggtccaggagaagagactccttcctctctcaggttgagactcccacggcctggagattaggcaaagcctctgttcgatctttgcatgaaattaagtagtcttagtggtctattgcaggggtctctatctgtgattgacctttacttatttcttgcttaatgtactatcattctctttttttcttgaataaggtagtttacatattaaattcttcgctaaagatacagctcttaaattaaaaaatactactactactaccattttgctttagtcagtaagttctgccttaattttctgtctattttatatattttgtctatattttgttgatatattaaagttttttcttgtttttattaatatgatgatttaaggctctagaatttcttctgagtgcagatctacctgggtcatacagatgttgtcatatgtggtcagttcttttacaaatattcttcaacgtttttctctttggcccttaatgatataagaaaacttccaaaaactgtatgttttttagtgttttggagttttattgtttatttaatttcactgcatcttaatcaaataattaaaaatgctttttagaaattactgaagttttgtggtctgaaatatagtcttttttatgatctgtggaatcaaaaaaaaaagcattctatatttttaaggtgccaagtttgttatctgtcaattagagaaaactatgtgatttacatttttacatcatgacttactattgctctcttcagcagtcacagcctgatagaggtgatgtaattttccctgctgtgctcctgtgtctgtgtctttccttatgcatgctctacttttttttttttttttttttttttttttgagacggaatcttgctgtgtcgcgcaggctggagtgcagtggcgcgatcctggctcactgcgagctctgcctcccaggttcatgccatttcctgcctcagcctccggagtagctgggactacaggcgcccgccaccatgcctggctaattttttttatttttagtagagacgggctttcaccatgttagccagcatggtcttgatctcctgatctcgtgatccgcccacctcggcctcccaaagttctgggattacaggcgtgagccaccgcgcccggcctactttttgttttaagaacattgatgctctgttatttaatctctagaattcataactggcatatcttcattgtgaatcacacgcttattttttcttttctgctactttttcttacttctatgctttttctgccctgtgttttaaagagaagaaaatcagtgatgccacacaaaacactccgtggtagtcagatcacagcgatggttttaacatttgtagtgctgacattctgttcccgttcttgtctctttcactgagttctcctaccatcaggcaggttccatgctcgtcaccaggccctggctgcaacttttcataccctatcaacatttggttcactgatgattgttgtttgctagattttccaagcagttccatataaacaatgttcccatatctttgaacattcaaaaatcagtttgtattgcgtttatacttgattgaaataatagttggtataaaatttccgggttgcactttcttggtgcaaaatttcacaggtctcagctctttcagtattgaatactgctacacactgcccttgtgattacagattcaagctggccatcagacttgcaagacacagacagctttaatctgatgctacatttactgggctttaaaggaggatacaggccgggagacacagctggtgtcctggggcacccacagctccctttgccctttcacctatccagggcctatgtggctgccacaaacaagagtcagggtgcttgcgggccacatggataatcagaagccaccgccttgatttcccaacaattttttatgctatttctagacacaaagctacaagccacatattgattcacagcccccctgttccaagggcaatggaacataggtgatgagggagacattccacatctatttcaaatctgtaatttccaagtgtgtctgttagcttctgttgattaggaaattatccccaaatttagtcacttcaaacagcaacagtttgttaacctaaggatctgctgaagagttcccatggtctgggctggctctggctaatctcgcccaggcttgctcacatgactgcagtgccttagcaggatggcagagggcgactagcccgtcatagcctgcctgtggtctggtggttggccatttgcctctggctcagcgtggcgattgtttcattattttgcattcttttgttgttgttgttttttgttgtttttttttgtttgttttttgtttttcgtgttttttttgagacagggtctctctctgtcacccagactggagtgcagtgacgtgatctcagcttacagcaacctctgcctctgaggctcaagcaactctcccgcctctgcctcccaggtagctgggattacaggcgagcgccaccaccgcccagctaatttttgtatttttagtagagatgggttttcaccatgttggcccgggtggtctcgaactcctgacctcaaatgatccagccgcctcgccctcccaaagtgctgggattacaggcgtgagccactgcgcctgcctgttgttaatagtggtaaaatatttggtgcagcttctcagtggccacattttacagtttcggatgcactttctggatcgggcatgcattttctgcttgtgtaactctgcttattttgcattattttaaggcatttataattaattctgattcctcattttggactatgttttgtttctcctgaaccgtctctttcctgtaggtagagggaagcatttcatggagggccaggtccctggctaggacaaggtagagcctcacagtcatatttggtatccagcggccattgctctgccccagcctgtcatctggctgtggtgggtttggtggcccacgtctaactctacctctgtttctagactgtgacccgggaccgggggaaattagtagcagcccgtgcctccagtgccactgtggcgagccctctaggacgggcctctcacattgggctttatggtgtccgcggcctcagtgtcagtactctgctcctccccacaagcagccctgctcagtttgccctgggctggcaggctttttctctgtgttgaggtttggcatttcacctcactcctgttttcattaaaagtagacttttcctttctatttcaagttctgtggatgattttgggagaatgttttctttatatcatctgcaaatacgcttcctcatttcccacctcgactttccatcttccactttcaatcttttctttttttggaaggagggtggggtattgtcagagttgtattttccaagagccctttcaatttctccatttttgccctttatcactgtgtgtgtgtgtgagagaaagagacatacagcatacatatagaaagatgtgcaaaatgtaaatgtatatttaacaagtggttataaagccatataatatgcaacaaccacacaggtaaagaaataaagtcttaccaaaacctagcagtctcccaggtgtccctctccagtcaccacactcttcctcatgcccctaccccagtacccccaggagtcaaacacttttctgcctttagtgtcatcatgtcttagctgtgtttataattttaccacctatatatgcattacgaaagagctgcttctccttgctatctttttcttgctgtaggtcttgtatcttcaaagatacttagaaatagggttccgaatataactttttctgtttctgcactctctctcttcttttgtgtttcctttaatctgtcagactgattttgttccactcacatgaaaactctgtccccagtgcctcctgatccttgcctctgcattcatgactaagtgtgatgcactgggagatgactgggagtccgtagggagtgggcgtattggccagtggtccttgcctctgcattcatgactaagtgtgatgcactgggagatgactgggagtccgtagggagtgggcgtattggccagtggtccttgtctctgcattcatgactaagtgtgatgcactgggagatgactgggagtccgtagggagtgggtgtattggccagtggtccttggctctgcattcatgactaagtgtgatgcactgggagatgactgggagtccgtagggagtgggtgtattggccagtggtccttggctctgcattcatgactaagtgtgatgcactgggagatgattgggagtccgtatgggatggcgtattggccagtggtccccttaacagagcggacctttgttgttgggcatcacctgaccccagtgtctaaaggagaatttcctccttggagataacgtctgaccgcagccttctgggagccacgggaacggtcttgtgtgcctgcaattagaacacacgtaatcactttatttctgaatttaagcctcacccagtcccccatggttgcttatttgctgactcctagctaggaaactttctgagattctctgagtgaatcacatttgttttcttcgtaggttgtggctttctttattgtactaaatcaatgcctactagtctgttaaatgtcaaagaaatattaaactttttatattctaatactactcccattcttttgtcctagtgggcttaaggatgttttaatttattttgctgtcctcgtagttgattttctttcttctttcttttttttttgagacagagtcttgctctgtcccccaggctggagtgcaatggtgcgatctcagctcactgcaacctccacctcctgggttcaagtgattctcccgcctcagcctcctgagcagctgggactacaggcacccgccaccatgcctggctaatttttgtatttttagtagagacggggtttcaccatcttggccgggctggtctcgaactcctgacctcaggtgatctgtccgcctcggcctcccaaagtgttgggattacaggcgtgagccaccacgcccggccttagttgattttcttaaggcagagcagataacatttgtgcttacactaccacatttaaccaacatttcaatcagggatagtttaaataaaactttatataagagtttcccatttcctccattctctttctagaagttttttttcttttttttttttagtattgttattacttgtaactgtctgtgtgagtgcagagatataatattaaaatttatcaaatttcagggtagtgatattaatcatttattttagtagcaaaattaaatgttaacattcaactgtaagattggaagatttaactgtcttttcccccattgaattaatacagaacaaaaatttatatttctgatacagacaggagacagggaaatactgggtagaagatgatggtgccctgacaaaggctctgccttcaagcctggaagcccatggctctaagtggcaacaggcattcctgttttcctgcccaaaagttgccttttcacctgccatgccccactatcctgtacccatataaaccccaatccccaggctccagaagcaggcaaggaagtaacaaacagaagagtagaagaatagcagaatggtgtggcagagagaagagaaggaacatctgaacatcgagaggagttcagctagggatggttggagaggagattggctgctggatggccaaactccaggggaagatcatcttcccactccatccaccttccagctccccatccatcccactgaaagccacctccaccactcaataaaacccccgcattcatccttcaagtctgtgtgaaatctgattcttcctggattctggacaaggacctgggtactgagagggcactgagctggttaacacttaagccatctgcaaacagcaaagctaaaagagtgcactgtaacacacgtccacttgggctttgggagttgcaggcacccacccttagatgctaccatggggccagagcccaaaacacactcagcctggctcctgcacctgcctgtgtgcccccctcccataaggggtttgagtgtgcagtggcagaacatacgagccacacccctgtcgcatgtcctgtgaggggggtcagggaactctaccgtttcatttccactggttgatatgagattttgcaaatgatacactgtagatcagatactctcaaagaaaaaaaaaggctacaaagttgtagtgttcaattaccttattcatgaatacttttttcctaacctaattaactcaatatcttggcatcactaggactttgagctttacccaatacgggtttctttcttcccgaagcgtttgttttactgccccattttattgctttcaattaatgaaatctgattctaaaaccaagagttcctgaggtgttagccaccaccactatcctccctgctgtcaccttcattctatctgttccacctatcttttgaggacatctagagttgaggttattaaccttatatcatgttcccttctccccccatttgtactcattttgtttagtgtgggtaattcaaatgtaaattgttttggtcacaaaccccaactgcttgctcacagaatagcctgcaatctgccttttgcaatgatcactccttcctggagggtacgttggcatcattgagtctgatggcacctgcttctgccatgttagaacactgcctgcagccctaggatctggacttcagtcagaccagcaacatattcgcttttttctcttctttgtttgcctatttctctgtcttctaattgttttaaaggtgaaggagagtagtagtacagaaataataataacacaaaattaaaattaaattaaaatgtaaaaaataagtacagaattaatttttctctggcttgattttaaaatgttagttccaagtgctttaggttggagatgtttccgacccgagcatgtcttcccccacgtaagcatcccttcacacattctttgaaatcagctgctctgatcctaaatgtaggcctcacgtctcaccagctgtataatcttgggaaagtaggaaactcactttacttctttatttctgggacagggatcctatctccaagagttgttgaaaggattaaatgatacagtgcacttaatgttcctggtagataagaagtgctctataagtagtgaccatttttatcatctgtgtagatgttaaagtttgccaggatattctaggattatatactctgcaattccgtgctgctttcatacgtttgctctgataaaacttccctaggacactgagaaaagatttttcagggctgactaagccctgcttaaatattttccagctgttctggttcttaagaaagaaaaaaaaaatagattcttaaaagagaattaactcatttattcttactctttattctctgtgtctgaggggagaccctaccaacctcccatctatgactcccagtaatcacaggatacatcattgtctgggaagagagggagagggccacaggcttggcaaagtccgaacttccggtcttcctgctttccaatatccccaggcttctggccttgtacacggttaacgtgtttcagctagtgctgagtgttgcattctgccccttcaaccagatcacttccgctgaaagtttgcatctcccagtatcagtgttggggaagccaaatgaaatctatcaatcccagttcagaatgtaaagaaactgaagatcctctttccccatatggattattatatcatcatagcatttggagaagccaagatcaacaaaaaagcagttagcaggtatgcatgtgtgtgtgctatttgaacattacacatagtaatttttcagaaaagattctcatctctgaaaaacttttcctccctcaagacaaaaagaagtatagctcatttcattttaggatataatctgtctttgggcttcagcattttaaaattagacatatctttgatagaatattctttcaattgttaatttctccaagaaagttcagctctctggaatcagattgagattttttgttaaatccttatatttgtcttcagtgcattcatgttttaaaacaatacattgaaaatttggaagtgtttttacttcaaataactacattgtctttttctaaaatgagaagttgcagtgttccatgttctgatttgatatttttcctgatttctgttagtagtcttggatgttttctgtacttgtatttggagtatgcacacttgtctgagacagttctatttctcacagtcttcactgtgccacatatttgcttccctgtcatcttcaaaagagtgggctaaggccaggcgcggtggctcacacctgtaatgctgacactttgggaggccgaggcgggtggatcacgaggtcaggagatggagaccatcctggctaacaaggcgaaatgctgtctttactaaaaatacaaaaaattagccgggcatggtggtgtgcatctgtagtcccagctacccgggaggctgaggcaggagaatcacttgaacccgggaggcgaaaagttgcagtgagccaagatcgcgccactgcactccagcctgggtaacagagcgagagactccatgaaaaaaaaagaatgggctagagcttggctacactgcgagatttattgtctttgaactgccacttattctgagctgctcacttccattaatcagcctgacttaccgactctggaattgtgtgctcatatcagacaggttgtggctaaagtccatccattacatttctaggccctcacttctctgtacaaccccagttcagtcatgctggcaaatatgtggggagcgctcagccctgaggagttccataagggaaagttccacatgggcttggattatatacctaataactcagagcaaatttgtgaaagcttcacatgtcatttacaatttgtaggcactgcagaactgtagattctaaagagagaaggctatgccttctgatgatagtcttaaatcatggaaagctaaaacaataaacacctcaaattcagtgtatctttgccttggaaaaagggttagacttcatggttgcaattcacctcactcgcctgtggttcattgattctgacatctaattaaattgatcatctacagtgatcacaaggcgattgtttgccaaacactactggcaaagaaaacttagctcatacttgtaatttactttaaggtttctatccggaattgggaacaaataagaaattggttttgactaggaaattgtacacaattgtaatcataatttggactggaataataaccactgtgcatttgcttgtttctgactttgttagtcttcataatattcctttcaggaggttggctatatttatagttaactgaattttgccaatgttttctttccacaaagcttgttgtatttaattgtctttaagaaaagaaacgaaaagtatctgtcaactttcaagaaataaaatgtttttgttaaaaatcaatatttattaaagcgaatgtcttttgaaaattcaagcaatatataatttgcaaacatttgattaaaatagtttcagtaatatatttttagcttgaatgggtcaagataataaatcaatattttctctcaaattctgataacgtgtaaaaaagttctttgaaacaataataaaacttaagaaaaagcagtcagtaaagctactgatgattctttatttccttttatgagataatcagtcttttgacttcagcattttaaaattaaaaatacctttgatagaatattcctttcactgttaatttctccaagaaagttctgctctttggaattagattaactaatgatattttttgttaaatccttatatttgtcttcagtacatcctagtagacttgtttagatagcagacccaagagttaaattcaaataattagcaggaatggaaaatagaggattctaatttttcttaagaaaatgctttcttatcattggcaaaagaatgagtttattcacagacatttttattccattattctgtgagtaaagaaaggaagaggaggcatgttgaggttttcttttcctaatgatgttacattaattattgtagccaagatacgcttttgaatacgatacaaaaacatacctacaataatgatcataaaaatattcctttttccatcgctgaaaattgcctttatttgacaggatgatcttctatgcatctcatccgactgtctgtatttcccttctgctttggtggagtggggtgagagagagagagagagagagagagagagagggagggagggagggagggagagggagagagagacaaggcggaagcagagcctttgcgggtagagcagataaagattcccagacaaatttcatgggtgaagtggccaatttacttcttttatagctgaatgtcattttttttgtggatttttccatcaagtagtgaaaactcacatattaataatattcagagtctcctctggccatttaagcaccctctttgtccagagtcaagtcagattcttggcggccctcctggcgccacgtgtgtgaggtggggggaggtttctcacccttggcgatcctctcctccgcacaggggcgtctgtgggggtgtccgccattttgtttggtctcagctgccagttcccagaggaaccctctcttctggccacacgcccgcttgatggtcacaggcctccgtcagcggcttctccatccctctctggcaagctgaagtacgtgacgacttccctggccctctagggttctcaggccgtcaggtacgggtctctgtcaatctggcacctgacagctgagacaaacgaaaaagacgctccgctcgctgattcctgggccgcgcggggtcacggggcgctgcggctttcctggaatctcctcaggattcaggcacaccctgtgctctcaggttcactaaacccgtctggggtttctacacacgacctgaaggcatctccgccctttggcggcagatagaggaatagaaacgactgaggagacatgaagcagggaggaaaagctggatgagaggaagcacagggagtggaaggcaacgtccaggagacacggctcctgatgccctttcgtctcggtgggctctctgtggcgaaccgttgtctgcttgagaggaaaagggaagtcatatttggtgccatcctctggactccagatgtttttgtgcctggccataattatatatatatgcgcatatatatatatatttgcatatatatatatttgcatatatatatatattttgtttgtttgtttgtttttggagacagaatctcactctgtgcccaggctggagtgaagtggcgcgatctgggctcactgcaagccccgccttccggcttcccgccattctcctgcctcagcctcgcgagtagctgggacgacaggcgccgccaccaggcttagctgtcaaattagctatttttaaggtaatcgattctgaaaggcaagtcagaatgtataaagctcaaatgaacttctctatgttacacactgtttctgtaccattcagtcttgactccactcttcctgccgccctcagtctagttgcagtccaggtgccctgttttcagttcctaaaccacaccatgtcatctctagcatcaagcatttttctctacagcatttttccttcctacctacaacccatactttatatagttaacttctattcctcatttttatcttcatttcgagtaacagacttgggaaaatcttccataaattcgtaagtttaagtggagaagcccttatgtgtgtgtccacagtatcccatagcgcttggtactgtgttaccataacacacaccactgccttgtcattgtctatttaccaccagactaagtccaagaggcttcttttttgttttgttttgttttgtgtttgtttgtttgagatggagtcttacactgtcgcctgggctggagtgcaatagcgtgaccttggctcactgcaacctccacctcctgagttcacgcgattctcctacctcagcctcccgagtagctgggattacaggtgcgcattaccacgcccggctaattttttgtatttttagtagagatggggtttcactatgttggccagactggtctcaaactcctgaccttgtgatccgcccacctcagcctcctaaagtgctgggattacaggtgtgagccaccgcgcccagccccaagaggcttcttgtaggtcttgtctgttgttctattctagtgccttgcacagtgcttgaaatatggaagaatctgtaaaaaatcatattgagtacagttggctctctggatccgtgggctccacatccttggattcaaccaactgtagattgaaaatattcaaaaattaaaaaaaaatcgcatctgtactgagcaggtacagacttttttcttgtcattattccttaaacgaaaccgtataacaactattcacatagcatttacattgtattaggtattctaagtaatctagagatgattaaagaaaaagcgaggatgtgtgtagcttatatgaaatagtgtgccttgttatatcagggacttgagcatctgtagattttggtgtctttgggggtcctagagccactcccctgcggatacggagggatgagtgtatggaggtggtaaatgacttgctccaggtcacattagtgagtgaaagagcaagggatgtgctctcggccattcagttctagaatctgtgcatttaaccacgatgcatatagccagacacagagctgttattccaaaacactgagaattagtaacaagggctctttaaactattggatctaaactaatttcaactagattaaatctacttcattactttttacaaatgttgtttcctgggtggggccttttggaatgatgaagttaattatgaaataaaaatggaaaaatgaatttcatccaaaatacattttctgcagatttaaatgtctgtgtatattacatatacacgcatctgtatctatgcatgtctttacatagatatatccataaatgtatatgttatatacagcgtattagggatagttctccagagacagaacacacgcacatatatacacacacacacacccacaccctggcgcacacacacacatccacacacacatatatgtgcacacatacacacacacacacacaccccgccaagcacctcgtaacaatgtttaacagaagaccacatagacaatggtggtaccatgacatgagattctagtggagctggaaaattcctattgcctggtgatgctgtggccagaataaagtcatagtgcagcgcattactcacatgtttgtggtgatgctggtgtaaacaaatcgtgctgccggtcatataaaagtatagcacagcccaggcacggtggttcatgccagtaatcccagccctttgggaggccgaggttagtggatcacctgaggtcaggagtttgagactagcctggccaacataatgaaaccccgtctctactaaaaatacaaaaattcgccgggcatggtggtgcgtgcctatagtcccagctactctggaggctgcagcaggagaattgcttgaacccaggaggcggaggttgcaatgagccaagatcgtgccattgtactccagcttgggcaatagagctagactccatctgaaaaaaaaaaaatatagcacatgtaattatgtacagtacatatttgacaataataataaatgactgttacctgtttatgtgtttactatatcgtatgttttatcattatggtagagtgtatttctacttacaaaaacagtgaactgtaaagcagcctcaggtacctccttaaggagctcttccagaaggcattgctatcacaggagatgacagcttcatgtgtgtttggcccctgaagcccttcccgtgggacaagatggaggtggaagacagtgatattcatgatgctgacccccgtgtaggcctaggctaatgtgtgtttgtgtattagtttaaaaaactaaaaattaataaacatagaggaaaacttatagagatataaagaaaatatttttctgcagctgtacaatatgcctatgtttcaagctaagtgttattacaaaatagtcaaaaggttaaaacagtcaaaaggttaaaattaaaagtttatgaagtgaaaatgttacatcagccaactttaatttattaaggaaggaagagcgtttcttttttaatgatgtagtgtagcctctaagtagttttcatgaagtttgcagttgttacccagaccttcataggcgctcactactcactcagtgacttacccagagtagcttccagtccttcaagctctattcatgtgaagtgaactacacaggtataccagtttttatattttataccataattttaccgtcccttttctatgtttgggtacacaaataccattgtgtttccgttgcctgcagtattcagcacagtaacctcctgtacaagtttgcagcctagaacaataggctctactgtctagtccaggtgtgtaggaggctgtgccaactagatgtgtgtaaatgcactctagaatgttcacacaaaggcaaaattgcctaacaacgcatttctcagaatgtatccccccttgttaagtgacacatgactccatgtatatatacaaagagagacatagagagagagagagcgtgcacacacaagaatgacagggagagagagatttattataggattattatgggaattggctcccataattctaaagactgagaagtcccatgatctgctgaagaactaggaaagccgatggtataattaggtctgagtccaaaggcccacaaattaggaccaccacactagctggctgtggtgtcagtatctgtcatcccaccgatttggggggctgaagtgggaggatcacttgagccaggagtttgagaccagcctgagcaacatagagagaccccagctctaaaacagaaaaaagaaaatcaggagcaccagtgctccagggcaggagaagatggatgtcctaggtcaaacagagagaaaattctccctttctctgtgtttttgctctatttgggccctcagtggattggatgggagtgcccagctgcttagtgaaggtgatttcctttactcggtatactaagtcaaatgctaatcttttctgggaacacattcacagacacacgcaaaaagtatgatttcccagttttctaggcatcctttagcccagttaagtgggcacgtaaagctaaacatcatatacatgtatgtatgaatatatacatgttccttaccctggatttctctttccctgtcactcttataatttgtgtatttatttggggaaagaatagttatcaagaatttctagaggaagccaactgtctacataagcttcagagttacaacgcctaactctatccaatctaagttaaatttaagaatgaatgttgagtacatctggtttgtatatggtgttttggcagagctcaatttaattcatctcaaaaagcatccagtgagcacataccaaataatggcctcatttcaggctttgggctgtataaataacatacatcccaatgtggggaaaccagacaataaacacaataatttacagagaatttaaaggaggatgagtgtcatgagaagaaaatagtaaaaggtaaggaggagaggaactacatcgtttgggattgcaattttaaacagagtcaaaacttgaaataattttagtatgttgcaaatatatctaaaatacgtaggacgtcttgcatggtcacgtaagtctagaattcgaaaaatagctagagaataaactgaaaattcaaaattaatatattagaaaaattttggaacttttatattatagcaaggtaattaaaatattttcataaatgtacctttattttgttatcaggaattaggcaaaggctgttgaaatattcgcaaatacaacccagctctagaaatcaggaagtggtgctctacggatatgcaggagggagtgctgaaagaacagctcatgaggtagtgcaggcagaggcaggttgatggcagcagtgactccaatttgctctcactctgtgtctccattcactttggtagtgcaggcagaggcaggttgatggcagcagtgactccaatttgctctcactctctgccttcattcactttggtagtgtcctcttacacagacgctgggattggaaaccagattgctttgacaaatgggaaattagcaaatatgagatgtgcagcaacttgagaagtgctcatgtgctgaggcatgtttattgatacacttagagacccgagaccactatgcaaatatgcgcccaccagccctctggaggatgagatgattgcctccaacaactgagccaagcatggttttatttttgtttttgtttccgttttggttttcagatggagtctcacttttttgcccaggctggagtgcagtggtgtgatcgcagctcaatgcaacctctgcttcccaggttcaagcaattcttctgtctcagcctcctgagtagctgggactacaggagtgtgccaccatgcccggctaatttttgtatttttagtagagatggggtttcaccatgttagtcaggctggtctcgaactcctgacctcaggtgatccactcacttcgtcctcccaaagtgctgggattacaagcgtgagccactgcgcccaaccctgagccaaccatggtttaaccaccagtgatctgagtggccaggtggtctctgatgatccacaagctgaccaaggttatcacagatgctcacataagtctagcccagaccagaacttccaagcagagtgcagctgaaattgctttcatagaatgagctaataaatggtcgtcatgttaaaccagtaaggttaagtggtttgttacacagcaaaagctaactgacacagtgcatttaactacttcaattctgatagcccatcacagaatattttagctaagaactacatctaatttatagtcctttatatttttttctgttggaagcatttcatagagacaaactagttgctatttaagtaaaataatgcaccattatgcatacgtttttgttacctatgtagacaatgagaaaatagaattgttttaaattcctagggacacttataagttctaggttgacatttatcaaattttcattattatgtctaagcacagtctttccctactacctcccaaataaagagttacctgctaggcgcacatctatcccacgaatttgtcagctcaaaggaacaaggccagcagttatgcttgattatacagaataaatagagtatgaaaattgaaattagacacacttactataaaatgtgatgattatttccattccaggaccaaattgaattaaaaaaaacttattgatctggattgaatttcaatttgctaagatttgagcaagccaacttctgcccagtaatgtttgaatagaaaggcttatgaggccaatagtctgttcatcacaggtgataaagtttttttttaaagtcaataaattactttttactacaggagaaacgtatgctttatatgccaacaaagagttgaaatgccagaagcacttgaggactaaattacggagcacttatttcatcacaacagaacgctaacgcgggtgcttgattacaacaagccatccaattgcatgaatttgggctgcaaggcacccaggcttttatattcattagcaaagttattgattctggaaagttacctctaataaaactacaccattttctcaggcctgttatatgggcgcagacaaattatttgatcaacgatattgagcaaaaggaaaagcattcattgtctctaatctcttttccctcctcccagaattgtacatggcgatcatcagcagtatgaagaggagctgtggggccaggtctgatttggttttatatagctatataaatatttgataattaaatcacattgtttcaataagaatattaaataaaagctaaagttaaaaatgacaaaataggccgggtgtgttggcttacgcctgtaatcccagcactttgggaggccgagatgggtggatcacttgaggtcaggagtttgagaccagcctgaccaatatggtgagaccccatctctactaaaaaatacaaaagttattcgggcatggtggcaggcatctgtaatcctggctacttgggaggctgaggcaggagaatcacttgaacccaggaggttgaggttgtagtgagcctagactgcaccattgcacttcagcctggtcaataaaagcaaaactccatctcaaaaaaaatgacaaaatagtataatattatattcataaaaataattttacatttacacaaaggtgtaattcactgtacattagcttcaacaaaacatccataagttattcaattcccagttatcggctgcttgaacttttatgccctttagctccatctgttaaagaacgcatacctccatagagctcccataaaatagtttttaattaatttaatcaaagaatattgttccaagaatatagttaatacactgaatggaatttttataaataaaattaataaagatggaaatgtgttacttaaaaaataagattctagctattctatcattgtttgtgtttccatttaaatattagaatcaccttgccaaattccacacaaaaatcctgctgatattttgattggaattgcattgaatctattgcattaatttggggaaaattaatatttaaaaatagtgagttttccaatccaatcacaaagtataccttaccatttattagaaatttaattttctcagcaatgttttagttttcagtgtggacattttccacctattttcttaaatttatctctaaatatgacatattctttatgttcttatataaatatttaaagttcacattcataagaaaattcaaaccaccaactgggagacattatttgtaaaatatatgtctgacaaagaacttgtatccaaaaggtataaataatttttgcaattaaataataacaatataaagaaaaattgcaaatatggaaaagattgagatacatttgaaaatagaaaatacatgacccacaagcagattaaaagctgctcaacaccatcagttatcaggaaaatgcaaattaaaatcacagcaatttatccattcacacactaaaatgattacaatttaaaacccaatagtaataagatttggcaaaaatatggggcaacaaaacttctcatatactgctgaacagctttataaaacggtgcgaccacttaggagaattgtttggcagtttcttaggcttagatatttgtgccaaagaattgaaacctggttcacaaaaatacttgcctagaaatggtcacagcagcttgattcatcatagccccagaagagagacaacccaaatgtccatcacatcacagacatgggaaaatgaatcaacaacatagatctcatgttagtctcttctaagtggacaggtttttattttccaatccagtaagacaaattctctagaaaacggcatagtacccacctcacaagttcactgtgagcattaaatgaattggtttatttaacacatgtcaaacattgtctggaaaattcagagcactatatattcagagcactatgtatatgagtcttggttatgagtattactgaaacttctatgtgccttgcttttcctgtatttcttgtcacctcattccccttcctcatggctccttttgaagatagtatttaatttacatctccattactgtttggaagctatgtcctttgttatactattttaatagtcacccttaaaatttgaatgtgtgtataaaacgtaagtcctaaagttaatcagtgtctttactttcttcaccctcagattcaaggacctaagaatgatttatttctcatcattcctttcaaatcacacttgcagttgtatttttaaaatttctgccttgcttttataacccacaaattagacattgtttgatattaacaaaagcaagagtcagatctcctctgtgttccttgtctcccttccttgatacatttcagaccttccttatgggaccttattctttgtttgtttttgaagcccaaccttagaagctgttttatgaggcttatttagaagtaaactctttcaaaatctgctcatttgtctttattttgtcctcattctcgaaagatactttagccgtataaactattctccattgcccattattttctctgaacacattgagggcgtttcactgtgttcttgctttgctcattgtttttgtggctcagctagctgtcagtctgaatgttccttcgtaggatgtgcgcttgtttcttctagatccctttgagcactgtagacgcaggtcctctttatagtacaattttggcttgtgtattgaggttcgcataaacagtatgggcttaggttcccaaccatggcagcccagtgggtaccacattaacaggggtgaagtttttactttttctccatctttatgaaaattgagacaggagttaggtagattgtttttccattctcaggggtctggctttatgcagatggtctcaggtttgaactctaggccacaggacactgggtgtggtcccagggagtctggtggcttcaatgctagctttcctccctgtgctgtgctcctgcctaggtcctgcccacatggacttccttcaccttcatgcaggctcatccatgctttacacgttatgcatgcccatttgtgtgtcccaacttagcattttgatttgttatatgaataaaaatcaagagagatgcaagatccgtagtcagtcatatttgtggaaatcgaaatcccccacacattttttcatccatttgaatttattaagtttgaggaaaatgtcttaacaaataagcaagtttggctagtcctagaaactatatctctaacttctaacttgggagttactgtaccaattatatggtgaaaaaaattatagttcataattatttggtattaaaagagacctaaaaattattttttattcattccttttacatctatgaggcaaaatgacaatgcaaaattatataaatgtgattatctacccgcaaaatttggattaaagactattttcatgtgaaaaatgtgaaaaagataaaacgtcacacagactgtgagaaaaaatgtactgttttcacatgttcttgtaaatatattcttatcctttttatctaacgtgtagctaaatatcaaagggccattgactatatatatatatatagctgatgctgaaaaaggctgttgaattgtttcaattaacaatatagcaaaaatactaaagcctttcacttttttttttttttttttgagacagtctcactctgtcgcccaggctggagtgcagtggcccgatctcagctcagtgcaacctctgcctcccgggttcacgccattctcctgcctcagcctccaaagtagctgggattataggcacacaccaccatgcccagctaatttttgtgttttttgtagagatggggtttcaccatgatggccaggatggtctcaatctcctgacctcatgatccgcctgcctaggcctcccaaagtgctgggattacaggcgtgagccactgtgcccagccctttcacattttatatcttgtaattctctattctgctctacaccatagggatgatccttccaaaagcatcctatctagattctgctgttaaatcacctttgttggcctggccagttatcaaactcaacagccccttcatcatcaaagactcgccctctatccgcatctcattccttgcttccgccaataatctgactagtaaagaagtcactgcatgccacaaattgtcagtgctgacttcctcaacaaggaagttatttatttacttatttaatatatgagtgactcagatgcaaattccatcttgagaataccaactcctgatgccaactgattgtcagtcatggctacaacaggagactggattcactcaaatagttcaaataaacagaacgtaatagagggactacttacagaagtgaagcagggttgaggaaagacacaggggatgttgagctactcagagctgcagtgacagcatgtggaaatagaattactgaagttccataaggctggaattgtgagagtctatccaggagtagctgaatttgcagaggaatgcagctgtccacagaaaaacaatggcaaaggagcaatgcagcagagaagacatagtctaatttctctttactttctactgtatgatatggtagaaggcttgcttttggctgtgctggaaaacatacagaaaggaaaaccaaaagataagctttatgttttaaaatctccactcaagatgcaggtggaaaattagaaagccactgtggtgatgttaaaatatatcttgtatgtctgaagtcagctacacaaaggagaaaacatcaaaactaattgcattgattgtgtagtttcagtacctgttaaatgcataattccatcgattcagtttggcaatggctgagcaactaactgactgtaaaggaaaaggaccctaagatttagtatggcaaaccgagataaagttaagaaattctagcccaccaatctcctgaaagctctttgtagccagaatcacctctgcctaagttgctcttggcttgaagatctgctctgagaagagataccatgtacgtcaatggaactacaaaatcttgaaaacttatgcgagaaggaagctggaaagcataaaaaaaattaattcttataaactttttttttctgccttctcttccctctctagctataattttggatttgtctatttttattttcatttatatcaaatgttgtctcatatattttgaagctgttatgtgatgcttgcatttaggattcttgtgtcctcttgatgcattaacaccattataaaatggctttctgtaccctggcatccctctttttcctgatttaatatgcccacagtagatttcttattattagaacttatgtagtacatttttgttcttcctgttacttttaaagtgaatttcttttagatggaatgttgttgtgtctatgaaaaaacagtctatgttttaaaatttagtatttagactatttacctttaatgtaattatgggcatagtagggtttaaatctaccatcttgctattcattttctatttgttccatatttttcttatttcttttgggtttccacctttttccatgttaattgaatattatttaatgtttgcacactatggccttattagctacagctctttattttattttatagatgttgtttatgggtttacaatctttaactcataacaatatactttcaaataatattttaccactttgcatataagaccgttaaacagtgtactttctgtctcctgtccatttttaatttatcacaatgtaccttcaaatcatattatccattttgaaaataatataagaaacttaaaacagtatgtgtccatttttctcttttttggagaattaccatgcattttatttctgcatatgttataaatttcacattacattttcttcttgttttaaactgttaattttattctaaataatttttttaaatgagaaaaaaaattgaatttacccccaaggtagcattcttgtgttctatcttttttgcatattttaaatccaagtatctatttgatattattttcttttattataaataacttatttctgcatttattgtagtgtaagtctgctgttgacaaattaccccagctttttttttctaaaaagtttatccttatttttgaatgatggttttgctgtttgctgaatttacagttctaggttgacagtttttaaatttttaaagtaaaattctaacaccttgtttttgcttcatttctgataagcttcagtcattctcatttttgttcccctgtgtgtagtatgtattttttctccagttgttttaaagttttttcttcatcactagtttacagtagtttcatttttatatagcttgtggtgcttctctttgtggtttgtcctgattttagtcagctgattggtgagtgtatagctttcattaaaccagtaaaatgtttagctattttaagtattttcctacctccttcctccccatcctgctcttgctttctcttggactctacttgcatgtatgttagattgctggctgtttttctactgttcactgattttgtatcttatttttagtctttttttctcaccttgcttcagtttggatagtttctgttgcaatattttcaagtatgtccatctttcctttcacagttttgagtatgctcttaaatgcagtgaatttttcaatttaaatattgtattctgggccaggtgcggtggctaatgcctgtaatcccagcactttgggaggctgaggagggcggatcacctgaggtcgggagttagagaccagcctgaccaacatggagaaaccctgtctctactaaaaatacaaaatgagtggtggcacatgcctgtaatcccagctactcgggaggctgaggcaggagaatcactagaacccaggaggcagaggttgcagtgagccacaattgagccattgcactccagcctgggcaacaagagcgaaattctgtcccccgccgaagaaaaattgtattctttagtcccaactattgatacatggataaggtgtaccatcgccaccaccattatcaacatcataacaacagtgttttatagcacttttaagactataaatgcttttatatatattaacagattttacactcactgaggcttggttatttccatcttaaagatatgaagtgtgaggctcagaaaataagtcagttttacaaacatactgggaaaaaaattgtatgctagaactgaaatctaaatctatccaagtcaatttttatttgctacttcatgctgcccatatctatagttgatcttttaccataccatgatcttaggagactaggaaacaataaaaccacaagtaagaaaatgattctttctatacgtttcaaaccaaatagctatctaagacaatttatccagataatccaagtcaaataaaagtatgcttcagttctctgaatattataagcaaaagtgtaaaagatagctttgtgcctccagtgaagagcagtcaggcaaccagaaggcatacctagcaatataatatttattatttcttgagcttttattgttcggtgttcaatagtcctgtgagatagttctcattattctttatttatacatgagaaaactgtctcacagaagttgcataacttgctcagagtcccatggataataagtggcccaggcagcacttgagtccaggtcagtcttgctttttccctttcttattcactgtcctaccttgcctctatgtttgtgtcccttcttagtcacttctcttgcactgttgatttgcctttttttaatacatatgtgctttatttactgcaattgacaaataattgtatcatttatggcattcaacacagtgtgtggtttttccttttttttttttttattttgagacagagtcttgctctgtcaatgaggctggagtgcagtggcatgatctccgctcactgcagcctctgcttgctgggcttaagcgattctcctgtctcaaccttccaagtagctggggccatccaggcatgcaccaccgtgcctgaattatttatttatttgtagagccctcttatagaagtctccctatatttcccaggctggtctcaaactcctgggctcagcaatcctcctgccttggcctcccaaaagccctgggattacagatgtgaaccgctgcacctggcctaacatgaggttttgaaatacatatatattgtgaaatggataaatctagctaaacacatacttatttttttatctgtggtgagaccacttaaagcctactctttcagcaattttaaagtatatcaccatggggtacaatagatctcttagacctgtccctactgtctagatggcattttgcatcctttgaccaacatgctgatttatctttaacatattgtattgctaccttgtggtaggcagaactttggtcgtcgtgatctcagccacctagcgttacatcctgttatgttacatggcaaacaggctttgcagatgtaattaatgttactcctcagttgactttaagatagggagattaacctagattatgcaggtgagctggatctaatctcatgagctctttaaacgtcggaagaggagggtagaagagaaaatcagagattataagtgaaaaggttggagatgtcattactggcatttaagataaagggggccaaaagccacagaatatgggtgccttcaaaagctgagccaatagctggcaaaatcatgagaacactcactcctgtagcaacatggagctgaattctgccaacaatctaaatgagcctggaagcaggttctccctcagaggctccaaagaagagcccaggccagctgacagcttgacttgcaccttgtgtgcccctatatagagaacccagtcaagccatgctgtactcagacttccaactcatggaacctatgagataataaataggtgttgtgttaatttattatggcagcaatagcaggctaatacatactttaggaacaattaatttcaaatttttgtgtgtgaactctcctcattcactatcatgacacacaaacacattcacccacacactctcagagatactcaagttgtatacttccagaagaggctttctctgtttttaaagtctgaagttctcagcattctcactgagccatgctatcacttttgtgtcactttggacagccttccctgcttctgtcatcctcaactttttcttgcattgtctgttttcccttttccctgtttgcacctcagttcttttgttttctgttaatattaggacctgattatatacacagctagtccacaaacacatgtatagttttcttcacaaaaaatcaaggaaggacattgcattgtgtgaagtgtttgcatctttatatttttattttatacttactgcaaagtggcatgtggatacttttctactgctggacacaaaggtatctattaagatagaaatattcctcatacacgtgctgtaggattcttggaactgaagaaaatttggcctctaaaaaactgtattatcataatcataagaattatatttgatagagtttctaatattttattaacatcaggagattcgattgaagtcaacatttgcaatttaaatgtggtattaagcactttgtttaaaggcagaataattataatgcatcaatgtgtatgtttctacaaatttgacaactataacacatgccacttaaaaccttatttaccatgcgcagtctcatataaatacaagctgtaagtctaagagccaccctagattccattctcttctttacctccagtgactagtccgtccccaaggtgagcttatttttcttcctgaatgaccctaaggggtaaaagtagatttgatagttggggacgatatgatttgtggttatacagaaaaacttttaactactgacactatacaaagctctaacttgtcctttggaggaaaatatttttcttactaacatttactgattagacatttagtgggaatatcaggcaacgtgctggtttcaaatggttggttgcaggtccctttcaaaaatgggcatttccaattctgcgtcaacatcattgtttacacagctgcagagagcacattcttccaggagcaccttcagggctttccgggaagcttctgggcttcgtttgtttggaatcctaaagcaagcagcctttcctgaaaagaatgtcctcaggaaatactttggaataaattaaatgatatttttaggcatttttatcgatctgttgtttagagacgattttgaatctgttgacttattttgtgataaacagaacttttacagcatctcaatggaatctgatttctagattgacttgccaccttgaaatgataattacattgtttttgagaagtaacatctttgtttccataacataagactttcagtttataacacaatgtacaattggggcttacttttttaaaagcactgatttatttgaaacctgtctaaatttggctaggtttcataattggagcaatcatcaatatagtatgaatgaccttatacaatataattttattaaataaaatatttttattaaaactaaatgaagtcataaaaatttgattttttttctaaagaaaaagtgtattgaaatccatggacctaaaatgtggcttattattaaaaaaatcctatttaaatatacttttgaaatagatacatgtttctagcatattttattcaccctgtacttactctcttatgagaattactccacagaaagtcatcttgttttatgaaaataactaagaaagtcattgtttttcttcctgacaacatttaaatgttggaagccacatctttattaagttacattcagctgattgcatttatgaaattaatctatgaggtcaaaaaagaatgaaattagtattcaaaagatatcactaataaaaatcattgatcaatttaaagaagttattaacatataacaatgttaagtagttcattatactttaaatatttccagtctattattagttaaaaagtaaatctgctagtatttcccccccaaattcattatttcaccgaattcctctcatctgaacatagcttagctgtattaagatgttgcgtaagacggctctcagaagctacttaatttattctaattaacaaatgtctgcattcttaatgtgttaattattagggctccccaatctcttattcgattttttcattcaacaagtatttattgaatgcttattatgtcaaaccctcttctaaatattggaataatagtaataaaacaaatcgaagtttatactctcaataagtttatgttgtaatgaaggatgcaaacagtatatacacactgcaatgtcagctagtgataacttttgagagaatagtgaaataacatacatacagggatagaaagtgatgggaaagccttgtctccaccgtccttctttccctctcagagctccagccaagtactttctccagcagtcgtgttaaacacactcccttctattattaggcatgtcctgacccctctatctgaaacacttgccctttgcctagctaactgctattcttcagtcacagtcaaatactgctccacaggcaagccttccccactcccagccatgctcccagagcatcatgaaacttccatgaaatttgacattgtttgtatgatgatttgttcactctattctcctcactagagcatgggattatatatatgtaatattactatatatatggcatagagtgaatgttcaatagaattagttgaacgcattattttaagtataatatatcaagaagacaggtttcaaagaccacatattttaaccattctgttcatacgggatgtttagaaaaggcaaatctatggaaaaagaaggtagattagtgtttatgttaccgaaacaccaggggttcggtcaaggtcctgctactcgctgcacagaaagccaatgattgagacgacgagtattgccaaggaagaatctttaatcaggtgctgcagctgaggagatggaaactcactctcaaatccacctccctgacctgctaaaaccaggagtttatataacagggaaaaaaaatgcaactgtgtgtaagaaaacaggaactagggagacgcaaggaagccatcacggtgaatgaggggtctggcatctcattgtctggatgtgatgatctggtgagtttcagttgtttgatacttttttttgagagacctgatggtcattttctgagggaggaactcagattaaacaaatataagtttcaagctttaagattagaagggtcaattcctatatttatcagaaaatatctatgagaccactgggtcagtttcatttacccagggctgagagagggaatggggattcactgctgactggcctgagggaacttactggaaagatggaaatgttctaaaactggattatggtgatggttgcagactaagcaagtttactaaaatcactgaatcatactaaaatcattgaattgaaaattagatgaattttatgatatgtaaattatatctcaataaaggtctttttattttttatttttctttttgagacagtgtcttgctctgttgcccaggctggagtgcagtggcatgatctcggcccactgcaacctctgcctccctggttcaagcaattctcctgcctccgcctcccaagtagctggtactacaggtgtgcgttactgcgcttggctaatttttgtatttttagtagagatgggattttaccatgttggccaagctggtcttgatctcctgtcctcaagtgatctgcccgccacagcctcccaaagtgctgagattacaggcgagagccaccacgcccagcctcaataaagttctttttttttaaaaaaaggtagtgactaggggaagtgtaaggatgtgggagtggccagggaaggtctttttaaggagatgctatttgaatagaaaattgacatgaaggcaagagccccaaagatgtctcgggacagagggctcctggcaggggagcagtggggatcttaggtgcattgctatgttggaagaacagtggggagtccaggtggctgtggcgaggtggaatgggggccacaggaggaagcggaggctagggaggagccagttaggtatgtgaggtttggttaattagggtcagggtattgaattttattttaaatgtgatgagatgctattgaaggattttagcaggagagcaacataatttggtttacattttgacagagtcactttggctgctgtacggaaaaacagaagcaggaagcccagataagaaattgagtagccagtcacgaaatggtggtgttatggatcagggtggaacggtggaggcggtgaaaagtatgtatcttatagatagaaatatgtgagaatatcacagcctattctaaaaactgctgaatcattgagtgcatatagttggagaagtgggtggagcagaacagcataagaagagagtaaagaagtgtgcagggtcagattacatgaggccttatagggcgtgggacagagtttcacttcatcttaaatgcagtgagaagtcattggaggatttcaggtgcggaatgatacagtcggactcactcacatgaagattattctgtctgccaggtggagaagagctcataggggaagaagcatagaaacccaagagcaagttaagacactaatggcagaggttaggcaagaggtggtggtggtgtagattgggacggtggcaatgcagatagaaaaataagcgtatacaagggctcctttagaattggaacagatgggataactggatatgaggaagaggaaactaaagagtgaagcatttttggtttgggtaactgagttacgcagtttttttttttgagatggagtctcactctgtcacccaggctggagtgcaacagcacaatctcagctcactgcaacctccacctcccaggttcaagcgattctcctgcctcagcctcccgagtagctgggactacaggcgtgcaccaccacacacagataatttttgtgtttttagtagagaccaggtttcaccatgttggccaggatggtctcgatctcttgacttcgtgatccacccgccctggcctcccaacgtgccaggattatgggcccgagccaccacacccagcccagttacagtagtttactccagaataatactacatgtataaacataggttacacacatacttaaaagaacattagagttcttttttgtttttctttgatgtttggctttgatttaatgggattttactatacacattactcttaagcaagcctttaacactcagcactttaaagtgcttggtacatagtaggcttaagtaatattttatcaaactgagctggagagttcttagatattgttcttatctcaaattcagtcatcccttggtatctgctagggattgcttccaggaaccccatgaatttttttaccaaaatccacagatgctcaagtcccttatacaaaacggtgtcttgtttgcatgtcactgacacacatactccgtgtacttaaaccatctctagactgcctataatacctaacgtgatgtaaatgctatggaaacagttgttttactgtatcgtttggggaataacatcaagtctgtacatttttcagtagagatgcaatgatcataggcctaactgccttttcaatctgcacgtggttgaacccatggatgcagagcccgtgggtgctgattgctaactgtatatcctacttctaatccttcttttgtatggagtgagcttccaaaaaccttctgaaacattaagtcatgctcttctttgaagtctgtgaatcctcagggctgtcggcgtgagaaccaaaggctgcagtggtgcacacaatgtccttcatcccagtaggttgattgttcagcatctgtgtgacccaacctctcctattgtccttgattcaatagctgatctactgaactatgtagctgaattacagctcctcaagcacagtgctgtcttggcttggaatgccctactgcttctgttattattatgatgacacattggtgatttttttcctatgagaatcttctctaatttcccaagtgtaagttagctatcctcctgtgtgtgccctgaaccctgtacatccccatcatcacagtagttcattgccttgtaattgcttgcttgcttttatgtttctcccattggacaatatattccttaaagccagagatttttccctgtgatattatcctcagaacttaatatagtatatgttgtcatactaaaagcttgatcaatacaacatacataagtaaaggaacattattcttctacattagagaatacagttcctagggaaagtatgtatttagaccacacgactgaagcaacaggtctggggaacacccatactcaaggaatggggaggaacaaaaggcattagaaaaaaaagaaatgggatagccgtgaaagcgcaagaacaatgttcagagtgtttatcacggccgtctggaaaaaacagaatttcaagaaatgaatgatcagtcatgtcaaatgcttataaaagtcaggaataatggctgtgaaatgtccaatcaacttggcaattaaaaatacactgatgactttatgaagcagtttcagtatgttggttgagacagaagccagatgatggggtgctgcataataaatggcacatcgcaggctgatgacagcacagccctgctttaatacggcaggaaacacgatgggttctgtggcatcctcctactcactgtcttctgtggattgtgactcctggtgactgacagatgtttaatttcctgagggcaagcaaagtcacggctttaatatgcccgagaataatgatggatgatgcaactttggataagcctgtagaagagacaagagaaaggaagaggtgtagaaaagctctgaaggggtctgggcgcagtggctcatgcatgtaatcctagcactttgggaggtcgaggcgggcagatagtgaggtcaggagttcgagaccagactgaccaacatggtgaaaccccatctctactaaaaatacaaaaattagctgggcgtggtggcgggcacctgcaatcccagctactcgggaggctgaggcaggagaatcacttgaacccgggaggcagaagttgccgtgagctgagatggtgccactgcactccagcctgggtgatagagcgagactctgtcaaaaaaaaaaaaaaaaaaaaaaaaaagaaagaaagaaagaaaaagaaaagaaaagaaaagaaaacagaaaagctctgaagggagaattcttgagtgtgtgatgtttgaaatactagactaaagggcagttcagtgggacagtgggtggaatttgcagtggataccagaacagagtttgggaagagagatttggccaagagactacaccctgcagatctccactgacagaggagttagtgaccaagagcctggccactgagctaaaatccatcgtgcacttgtgctgtaaccacattcccatgggctgctctccagccaatgactgaattggaagcagggatgcctgtcctgggagccatgagctcctctgatgcctgaggttgactcgtggacttccagtagctttgctgaaccttccatagactggaaagcagcctaagatgttttctcgcagacccctctggctccttcaccgttttccttttgcagtagttttcttaataacatccttgcatgtgtaatcctgtgcttatatcagcttctcagagggtccagaccgatataatatctaaagggtagttttatttttgaagggaggtgaattgctgtgttattagtgttgtacccttctatcattcgctatcattcatgtttctttaagatatattcggtaaaatacccatttctcactaatgctggttagagtaggtctttttttttttttttgagacgtaatctccctctgttgtccaggctggagtgcagtggcgccatctcggctcactgcaacttccgcctcctgggttcaagtgattctcctgcctcggcctcctaagtagctgggattacaggtgcccgccgccatgcccggctaatttcttttgtatttttagcagagcggggtttcatcatgttggccaggctggttttgaactcctggcctcaagtaatccgcctgccatggcctcccaaaatgctaggattataggcgtgagccactatgccgggccaggtcttctttcttgaggggagggacaaagtgaaataatgagaactgctctgcaatgtcttcttcagaagagaagctgcccatagaacagagtcccatgtagatgatacagtgatattaaatagaacgttccccacagaagtttaacgcgattagtatcaaggtgacgcttataaatgctaatgcaagaatgccattcaggagtcttgctttatacctaaaaaagcgatgtgttcctgattgtggaatatctttacaggtagaaggcaggtaatagttatatagaaataaaacaaaaataacaatgtataggatacagcctcaaagattcccagaatattagagctacaaggcacgttagagaccatctcctaattttaaatgctcttttgaatattctagtgagagaagctgcagcctgttgagactccacaagactgaagatatgaaaagaggaaatatgcatgaatgcccgcacggagaaccacccccacctgctgctcccgctctaatgatcacgcccattatcaactgggggatggctctgtgccttgtccttgcattacatggaccaagaacacttcacaggactcagagaggtaaatgagagaaacctattcttatagaggatgaaaatgaagcacacagggaggtaaagtgccccaaaatcccatctgaactggctttagaaaccgtatatttactttttcatataatttgtttatctaagggaaaaaaataacagatgtgtttaatggctttagaaacatttaaacaggtggacctcaaaatatgtgaaatgaacatattgccattgtttattataattttccttccttctatttttgcttaaaattcctcaaggcctttggatatgcaaaaaaaaatgagcatttgttttattatgttgcttaatagaaacaattttttaaagtattgatttacgcagtgaccaaaatactgattctaaacaacaaaacatgcagctgttacgaatcctggacgagctctggaaatgtgtggtattgtcttgcaaagaagctgtttttgttctagtcaaatatggaaactagtttagaaacttcattttaatatataattctgatttcagtgttaccagtaaatattaatgtccttttctaacagtcttaatttccttttctcaactcccttgagttatatattttattgaagcattcatttaccatcaagagaaaagaatgacataagcatgtgtgctgaaacgtgcggcttccaggccacagagttaaggaagctacatttgttctcccagccccttacttgtgctatgcatttagaaagaaaactttcgacgtctattgttcttacttttacaatttatgatgtagttaatcctattcaccttgtgtactgaggtaggtcagaatttcttctcacccttttcctcttctaacatgacctgttctttcgcatcatgagtcatagaaatgtaagctaatacataaagtttttgaaaagatgaggaaagagccagagaaataataatgccctgaggttgtgctataaggtatgttccacattggcaagaagtcccttgcttggtagatgtgttcctgtaagccctaaaagaaagggcaggtggctgtcatactccccttatcctccggacacaatcacctgagaccattcactaggccttccaaggggaagcccaggtgaaactgaaggacaacccttctgagatggacagaaaaagaaaaacgtgaaatcttatggtaagggtaaaaggccaaagagacttaggaactgtaaggtagggaggaaagaatgtgggagcccagagagacgggtcctctgtggccgtaacagtagactttcagtggagcgagagagaacatgaggaaactcaggatattctgcaccatggtttggactctaaaaatgtatttgatcatatgatgggtttatagtttttattcttggcctcggtctctgtttttttttcttcttatatgttgtagtgttgggattcactcagatggtggcagaaatattaaagggaaatactagggaaagttatagggaatagtcacaaaccttttggaaggctgaaagtttacatagcttgtaataattgaacaggctgaggcagccggttcttaccttagagcattaggtcttagggtaaatactagggacaacagaggcttccccacttaagtctgtttaccctacctccaataactaacctttgagccagatggcccacttgtggggaggttgactagggatattgtcccctaatggtatttaccttagaccttggtacctgagctttaatcattcctagaactactctcttaaccatgttaattatccacaagtgtgttgactcagagcttctgttgttaattgtataccaaataaatgcctggagtgcgagctgctcagggccagccacagtgacaaaccactcttggtgtgcaggcggtcggacactcagcaggactggcaaagcagaatatctgtgtcagtgtacgttttattcgcctgtcgtttgggtcagggtccatgggcagacccccgcagctaatgccctcaagggtgaggagcaatacctcattatagacttagttgtgaaaagtttttttaaaattaatgagacagtaatcaggtattttaaacaactgaattttacaaaccctcataacattgagtgggaaaaaaatttagatctcagtcaactccttgatcttacacataaagaaactgatgctcaaaatatgaaaagattttcccaagttaatattacacatgatcagtggatatgatactagagccagtctttgatctccaattccagttttcttactataataaggtggatttcttgtgagggaaccaaccggataaagtaaaaaacctacagtttctatgaggatccacatactttcctgacaatggagtaagagaaaatgtggcaagtgaccattgggccctccaggtgtcttagagtggttgacatagttcctgaacaagagtggaaatccagcctggcacggtggctcacgcctgtaatcccagcactttgggaggctgaggcgggcggatcacgaggtcaggagattgagaccatcctggctaacacggtgaaacaccatctctactgaaaatacaaaaaattagccgggcctggtggcgggcacctgtaatcccagttacactcgggaggctgaggcaggagaattgcttgaacccgggaggcagagcttgcaatgagccgagatagtgccactgcactccagcctgggcgacagagtgactctgtctcaaaaaaaaaagagtggaaatctaggtggattcagggatagggaatggtagcaaaaagagagagagaggagagagagggaagagtaaggagcacagaaatagaaagagcatctggtagtgagatgagctggaatctggggagagggacctgtgtccaggcaggcttcttacagagctgtctacttacagagctccacacccacagcgccaggtcagtgatttgtctgtcggtgcgcacccccattctgtgctcttttctgtatcacaggggactggatatctgcaagctacattttccacactgccttctgactggtatttaataagattttgataatgggaggcactggcaagaaatgggaaggtgggagaaagagcaaatccatatttttagtcattgtttttcctggtggtgcccttggcagcagtaaccacagtgacaagtggatgcaagcccgggttccctctaaggtggcacagttccaatggcagcagcagcagcagctgctctgacagctttgtaaccaccagtactcctgggccctggctcttgctgtatcaggagtgtgagctcctggcttcctgtgcagtggcagtggcagtgctcactgcatccggcagtggctaaagaaggactccagcctcctcagcccacagctgcgtggacttggggctacaccattgctctttggggttgtttttggctcatggggtggttgtggcatcctgaagttacgaacagcagttacgaacagcagttcctcaggtaccagtctttggggagcctcatccccttgttgttcctgcctggctttttgtgacgtttaaaaccaatgttcaaatccaatgtgtttggaatgcttagaattggttttgttttcctaactggacacgagagacacaagcactacgcgatccttctacgtcatgctcttaaaaaatatggcaaagttttacattattcatccatttctgctgttcccgtgaaactgacaatatacaaagaccagcgtgtgtggggccctggaatatgtcagtttatatttctattgtgtcagttttcttagggtatatggcgaatataaatatgactattataattaagtggctgtgcattttcatattagaattcattatgttgccttctcagtagaagcactttctatgtagtgcttgagcatataggtaagtcaggtggccacctgcacagtgtgatttgaaggtgtgaaggtatctctctgcctcaaatagcgattaaatttaacaggttcatattctgtagtgaaaaaaatacagttggccctccatatccacgggttctgcatccatggattcaaccaaccaaggataaaaatattttttaaaaattgcatctgcaagttaattataatataatgctcaagaaaattcacaacatgaatgaaatgttacagaagttataaatccattgcatttatcagtagctcatttttgaaaagggtctttggattatagatttccacttcttttacaaagaaacattgaagtgagaattttgtgggtactctttaaacaatagtacatgagtttaatacatattttttaaagccagtaaataacatttttctgtgtccactttaaagtgtgttgggtatataagtgaattggactgtatttctaatatgtgtgtaggtttaattttatatagtttttaaattgttctgtgattaatcggccattgaaaatgacctttttaattgttgagatttactgactagccttatatggaaggatttgtatatcctcaccatatatatatatgtatatatatataaatataaatataaatatatatggtgtatctatatggtgcatatatatagcgtgtgtgtatatatgtatttggtatatctatggtgcatatatttggtatatatatggtgtgtgtatatacacatatacataccatatatacacacacatatatataccatcttttatttgtgtggtgaaaaatactcttttttggtgtaaaaagtttattttctttgctaataatgtcagtttgtaaaaaaaagaattcatccttactgaatatctatagacctttttggtcagtattccctaaacaacgcagtataagaactatttacgtagcattcacattgtattaggtattataagtaatttaaggatgatttaaaatatacaaggggatgtgcataggttatatgcaaatactatgccattttatatcagggtcttgagcatccacggattttgatattagcaggaggtcctggaaccaattccacatggatacagagggacgtctctctctctctttgatattgttatattatatcatattatttatattatatatttatatattggtaatatttatatattagtttaaaggattgttataaaagtggattttaaaccacaacagcaaccaaaatgattatgtgatgttacagaggaatatggttgccatctttttttttttttttttttttgagacagagactcgctctgtcgcccaggctggagtgcggtggcacagtctcggctcactgcaagccccgcctcccaggttcacgccattctcctgcctcagcctcccgagtagctaggactacaggcgcccgccaccacgccggctaattttttatatttttagtagagatggggttttaccgtgttagccaggatggtctcgatctcctgacctcgtgatccgcccaccttggcatcccaaagtgctgggattacaggcgtgagccaccccgcccggcctatggttgctatctttaataaatattatggacataagagagagagagagaatgctgctaggtcacttaaaaatggagatgtgatttatgggaatgttcttgtctacatgtaatgcaacacgtggaatctttataataggtgtcaagaaatttcccattcaggagaattctgtaggtgaaggttcagagggagccatggctagatgctgggcaggggagggttagatgcagcctcactggaggggtcgttttctggaagtgatatctaacatccctccattatctggaagtgatatctaaaatccccaccattatctgaaagtgatatctaacatccacccattatctggaagtgaatatctaactttcccccattatctggaagtgatagctaacatccccccattatctggaagtgaatatctaacttccccccattatctggaagtgatagctaacatccccccattatctggaagtgatatctaacatccccccattatctggaagtgatagctaacatccccccattatccagaagtgaatatctaacatccccccattatctggaagtgttatctaacatcaccccattatctggaagtgatggctaacatctgcccattatctggaagtgatatctaacatccccccattatccggaagtgatatctaacatcccccattatctggaagtgttatctgacatcccccattatccggaagtgaatatctaacatctccccattatctggaagtgttatctaacatcccccccattatctggagtgatatctaacatccccccattatctggaagtgatatctaacatccccccattatctggaagtgatagctaacatccccccattatctggaagtgatagctaacatcccattatctggaagtgaatatctaacatcccccattatctggaagtgttatctaacgtcaccccattatctggaagtgatatctaacatccacccattatctggaagtgatatctaacatcccccccattatctggaagtgatagctaacatccccctattatctggaactgatagctaacatccccccattatctggaagtgatatctaatttccaccattagtgacactcctccatgtttcaaggtatgtatttcaagaaagcccttgttagaataacaggaatttattggggagaatagcacaatgtcttcttttttttgagacagagtttcgctctgtcgcccaggctccggtgcaatggcgtgatcttggctcactgcaacctctgcctcccgggttcaagcgattctcctgcctcagcctcctgagtagctgggactacaggcatgtgtcaccaaccctggctaattttgtatttttagtagagacgggggttctccatgttggtcaggctggtctcgaactcccaatctcaggtgatccgcctgcctcggccacccaaagtgctgggattacaggcgtgagccaccgcgcccggccacaatgtctttatcaatctacacgtaaggaattttctggtaaaatagtgctgggcagattgcaagtgggagcagtgacattgggtttgaacaacaaacttaaaagaaaagaaacaaagaaaagaacacataatctgtaggctgggtttctgtctgtctggttttgggatgcaaagagaagaaaaaatgaggtagtaggcatttagttattttctagcctaagattaaagtgctttttgctcctgcctaactttaggaaagtgaggaaacaacattcacagacaaaggacaattgagcatgagctccaggggaccatcagcaaaacattttcagaagatgtgaagagtaggatgcgtaagtcatggagcagatcagaggcctgtggataaggtaccaaggacaaggaagactctgtcggttgatgatcttgagcagtgctgctaggtcacttcaaaatggagacgtgatttatgggcatgttattgtctacatgtaatcaacacatggaatctttataatacgtatctatatttctatgaattaaagttttcctatggcctatagttaagtgttcttgcgaggtgtgtgagcaggtgcacctatgctgtacatgggggaggatgctagataaagaatattatctactctgtcttacagatcattcccagacggggtggtagaaacataccatacgaatgtaaggaggttcctaaaaatgttcacttgggccataagcaccatacaattgagcaaggttgcacatttatgaagctctacaaagcacaggttggtttagcattatctgctgagccattgggcaataccccgtgaggggcacagagagatgggacaaggcgcacagagggcatctggggagtcaggaaacagcatgaggacagggggcccctgggaatagaaggagacttgttcaagggaagaaactgaaaaacaaaacacaagggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagtatggggagacgatagggaaaatcagggtctctgtgtagttatctgtgtgactcagcatggggagacgatagggaaaatcagggtctctgtgtagttaatctgtgtgactcagcatggggagaccatagggaaaatcagggtctctgtgtagttaatctctgtgactcagcatggggagatgatagggaaaatcagggtctctgtgtagttatctgtgtgactcaccatggggagacgatagggaaaatcagggtctctgtgtagttatctgtgtgactcaacatggggagatgatagggaaaatcggggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgcagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctgtgtgactcagcatggggagatgatagggaaaatcagggtctctgtgtagttaatctgtgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagatgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggtgagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacaatagggaaaatcagggtctctgtgtagttaatctgtgtgactcagcatggggagacgatagggaaaatcagggtctctgtgtagttaatctgtgtgactcagcatggggagacgatagggaaaatcagtctctgtgtagttatctgtgtgactcagcatggggagacgatagggaaaatcagggtctctgtgcagttatctgtgtgactcagcatacatgggtaccgcatggatagaaaagcatgataaagtttgaaaaagtatttttaagtgttgatgatgatgatgattttgaatgcaaacatactttgattgtgatgatctcttcaattatgatgttgtacaaaaccaaaaaaataaaaaacaaactgatgttcatcttcaatttgaggttaagaaaactcattatattcccagcataccttcttgttgattgaatgattgaagagtaatcagcaaacaacctaatttctaaatccttgacagccataatgataatgtgaatctcacttggagaaattctcatcccaaattgtgttccattgcttcataggaatgtactgaatccgtttcaaagatcaatgaaaataatggcatgctcatatattggatttaaacatcttatatgattgtggttattgtgttttttttttttttaatttctgaaaacaaacaaaaggtcctaggagaaaagtaaacctccgtctcctgtcaagtcccttctcccatacctgcgtctctcattgaaagggtagtacagaattcaggttgggaccaacccgtgtaaccagcagtgataactagtcgctttattcctgaaaactccaggctgtgattacataagcacaggtgaatggggaaaagcaaaagccatggaggaaatccacctgcgctttcttccccctgccagcccagctttcacccaggactgttcttcatgggctgcacgcctcttgccactggtattcttaagcaagtgctgggaagactcgaaagaaaagtgtgagaggagcagcaggcagcgggtttggggaggaatgaaaagcagagatggacaatcctatggttttgccccgaaagaggacagagacttcactttactgagtctgtacaaacatctggaatcaaagccaagagaatgactgcgatctaagcctttctctaggccccaagtttacagcagtttatgctcctagaaagagaataatcactgcatttacccaactaaatatttctgtctatttctcatgaaaagtgaggttaaaggttaatgtaagaccattgcagcccataaatttaggatgactgtataatccttccagctttgaaattgtcataccttttttacttatccaaaatatttctaaaaacaacagaaaggtcttgacaaccttgatgactttatggaatgtgagataaagggcgatatatatacacatcacatatacacacacacatatacgtatatatacacatatatatgtatatatgtgtgcatatatctatacatatatggtgtgtgtacatacatacacaccatatatacacacaggatgtgtatgtgtgtgcgtatatatatattacatctatttacatatatatataacatttcctttgattcaatttgcaggcctcaatcttattctcagaactgatgtcacaacatcgtacaaagccctcataagcatatttgccttccaaggtaactcacagaatacatcttccatttgttattcatatagtcagctctagctgcaattgccatttaccaattcccatctgttagaggtttttcttgtacccgatggcagttgaagcagattgtgaatataaaagaaaatagtttcttggcacagaaaagggatatttgttttaattgacaaggtgtaacatttatgagataaaaatgaattttagacatctcatttatttttatgtcggtctcttcaagacaattattggctcttaggcatacatacagaaacctcaggaaattagggaaaagacagaaaaacaactcttgggaaagtcaattcaagctgatcttaaggctcccagggaaatggcaggtttggagggtggagagaattcaggtgacagtgccaattcttagtgtcttctgtgctaccatgattattttagaaaataaaggagtgctgattttttaaaaagcaatttcctctgctcagcaatgataaataaatcattttgctataaatgagtctagagtcaatgcttcaaatgagaaaaaaagcaatccactatttctccttaagaatgattatatatttgatgagtatctttcttctgataatgatttgtaaaatcttatttcttggtactcccatgagtagtagaatatattgaacagtaaaatgttaaacagtttttgagatgaaggcactgtttctattcaacttatcacaattactgagggtatcaggtatgtactggattgtcatagcttaaagagataccaggacgatgacaaaggaaagttgaagttagctattctgatcagtagaaggacacgcttttccccgcaaaggaaataaaagtgttagtgtcgttctgttgagataattttatcaaatagaaaaaaggaataaaaggaaagtcatctgtgcatttgtaacccagcgattctcattaaatcattataccatgctaacaagagaaaaaagcgtctacaggtggtactccattttcaactgggaaaagagcaggtctaatttgaaataacccaaggctaagggtgctataggatggaaggggaatttttaatcaacactatgggcacacatcaggtgtccccgagggccacgctatgaggaagaacctatgatatgttctatcttcttgtaacagtgctaccctctgggagactacttgcccagggctgggaatttatctttggagttagtttaggactcagggtgaaaaggaggagcagtaggaagtgaggctattggaaagcttctgtaaaaagtggccccttcattattattccatattctgactaagcagagaaatgaacctgtagtttcatccatattttcaaaagcaaaacttcttctactaaaataacttgctacaaaaggtatgtactagtttgggattttgtttttttctgtcagtttgataaatgctgtttggactctcataatccccctaataattgactggggtcagagtatctctagggcgatgctgcacattttaaaaccgcttcacggggtgctggtattcagagaatgctcttgaagatctgtttcccattgacttttcaaatcctgttaattgcttatacagtaagcgttaaaagtcaggcctggcaaaatcaaggaagctgcagggagcagatgaagttttcatgcgcaggagcacagctaggatgaaacgagaagtaactgccgtgtccagtgtggcccaggtggagagctgggggtgtgccatgagactgttaggtccagaggaagtacgctcgattcgcttgatctcgggggtaactgaagagatagcagctctctctagaagtccttttctgaaactattgagacctctgacacttcaaatccttaaacgcaggaaaaactaccaattgattagaatgcccttgagaagattgaagtatgagatggtgttggactagtggtcatttgtttcaatctcaagattctgtatttcctattctgaaatttctatttattataaatcttataatctttaaaattctatttttctaagtctgagatgtggttgaatttcagtttataagaagaaataaggcatatgtgaattcccttaacaaatcacacagttcaattcctgatagttgttacctaacgtttataatgtttctttttatcaaatgatcttcaatattccctgccatgaaatggaagattagtgaattttttactaaattattttggccttaaagtctgttctgccaaattgaaatacttggacagaactaacttttgctgtacaaagtggacagttagccatggagtgagctattgagaagaaagaatattttctgagcagaaaactcattcttctttttctaatagctgtattaggagattgaattggggccactatgctctttctcttgggcaggaaacatgtactttttttgcagtcagtaatgttttcatagctgttatctgacccttacactgagcagaagagtttctgggacagtttctttaagtttacaaataatcagccatgtataggcttaaaaaataaataaagatttctcatccatatgaatgagtggagcaaataaattagatgagggaagctggatcacaatcttgagaggaaacaagaggaaaattcagaaaacatttcacctatacctggttctgttaataccttgccactaccatattatggatgcaggctgaatacatgttttcagaggttagcactgcagccaagcaagcaagcatactgttaatctgatatatataaggacacacataacttacaatatagtaaagcaaataggcttgaatggcattgcagttcacacacactgccatggtgttgctattcaacttctgaaacataattttagttttgtcctcttgcctcccttgccttgctatagtgatttagctttaaaaatgcaagcctgcacctgtcatttccctgctaagcatctctattggcccccatgtcctcaaggatgcagaccaagtccattccagaacagcttccatgctccagtcctacccacctcagtagccctatcactcttcttactttctgctccaaccacaatacaattctagtggttgatcaaaatgtttctttttctttttttttttttgagagggagttttgctcttgttgcccaggctggagtgcaatggcgccatctcggctcactgcaacctctgcctcctaggtacaagggattctcctgtctcagcctcccaagtagctcagattacaggcatgcaccaccacgcccagctaatttttttgtatttagtggagatggggtttcaccatgttagtcaggctggttacgaactcctgaccttaggtgatccacccgcctcagcctcccaaagtgctgggattataggcatgtgccaccttgcccggcctcaaaatgtgtcttgatacaaagatttcccctacactgtaatgttcctctaatcctccctctcataacagctacttatccctcgggtttcatcttaaactttacatttagggagaaccttcccccacagagcagacatatcaggtcccctgtgtattctctaatggcagtcttgtatttctttgtaacaaaaattgaatttatttaacatatgactttcctaccattaagtcttttacttgaacgagggcaggtattcagtaaatgtttcttgaataaataaatgcatggtagttctttatcatttattatcattggtctagtcacagactcagaagcagttggagatactagtatgattgaatttctctatttttagtttctttcaaatacttgcacacacacagacacacacacacacacacacagacacacacacacacacacacacacacagcttccttgcagtttcccagaaatacaattccagagccacaggtccctcatctcacaacttgtccccatgttctcatttgtccctctgatcttacttgtcagcccttcccagcacctggggatcgtgcattgtgaagcagcacactcaggggttccctgctccgtgtttccctccctaatgccaaagggccaggagccattgtgtcgcagagtaggctgcttcacttgtgcctgagggaggacagacaatatgctcatcaggattcagggaggagagtgtggacgctcagacagaggagtgctgtctttgtttctcgctgctatatcagaatgccacagactgggtaatttataataaacagaaatttgcttcctcacagttctgaaggctgagaaggtcaggatttaggggccagcatctggtgaggggcttctcactgcattcttccacggtgccaggtggcagtgcaagaaagcacataagacacacagcaagaggaggctgaactcacttttataacaaacccactcaccccataatgaatttactcctgtgttcaacacataaacttttggagacacattcaaaccataacatgtactattgaaatggagctctgacaggagacaccttgggtgcctcaagctggagattctgctttgcatccccagttaataattagtagataaaagaaagagactctttgggcactgggacctggggtctatgaatgttgaaaaggaagagcaaaccatgacatcaggacttgagtttctcacacccctttctcccacccccacccaggcaaaaatagatacaaaagaagaaggaattacagaagaagtcacataacattattgcctacaactgactgtttaccttgaatacttgaagaccagaatgaagattcttggggtgaagaattacagccttagcatggagcaggcctcggtgcatcggctttcagctaggcatgcctgccaatgttcaacgtcctcctgggatacggaaggcaccgtgatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaatgataaggtttgatgtgctaatttcagcacctccacttcatgtctacactgtggacatatacttttttgttgttttggggtttttgtcatgtttcactcactttctctattattctttatagcaggacttgctttagagtcattactttctgttaaagttgttccttcaaaagttgacaattactggctgggcacggtggctcacgcctgtaatcccagcactttgggaggctgaggcgggtggatcacctgagattgggagttcgagaccagcctgaccaacacggagaaaccccgtctccattaaaaatacaaaattagccaggcgtggtggtgcatgcctgtaatcccagctactcgggaggctgaggcaggagaatcgcttgaacccgggaggcagaggttgcagtgagccaagatcacgccactgcactccagcctgggcaacaaagagtgaaactgtctaaaaaaaaaaagctgacaattacttttcattggcttcttcacacctaacacctatcttttcacacaaggcagaaataaattgctattagctaatctgctaaatccacttagaaatataatcaagaaaaaggaaaacatccttgtgtccaaggcattctgatttgtaaaaatggtttgtatgtgtcatttactcaaatcaactcatttcaccaaaagtactcagaaacataaccctaaacatatgtgtattccatcccaaagtttttcatgtagtcagtatttttgtatagtcacattataaaaatattttatttaatagtgttgttgatatattagtatatagtgtgagattcagatacttaaattttttgaaaacttgcattcattaacatatcaacatatattttctccttttatttacattaatctgtgatatcaacatgagagcaagaattatattgaaatttatatttttcctggaaagaaagtgaagttctgtgaacatgagtaatttgctcaccaccatctagccagtatgtctgtagaactgagatcaaaatccagttcttctaactctttctattttcaaagtagagattcctcctaatgccaaacaagagttccctggctctgttttctatcctaggaggtgattgtcttaatgattttgttttaaattgtatcttttttcagttttatgtgcagaggatataacatatacaaatataattcatggaaacactcaggttgttcagagttggaatgtcagtgattttgttgttttaagcactatgacgtgtaggagacacttacatatactaacagtatagaaaggaatgatcttaatattatattaattataattaattaacaaatttgcataaattttactaaaagtatgacatcagccaacagaatattagtagtcaagtgtgcacattggtgtcaaaataagacagtttctagcctcaaagagagtagttaggaaagcatcattatatacacaatatcatatagtatatcatatttctatagtgcttacaactacaaagcacttcccctccttttcttcctactcaaaatgatcttgtgaactaagcagggcagggcttcattctattttacagataaggcagccctagatcagaattcatggcagacattcaatcttcaaacacgtatcaagagactgctatgtgtcagcagtgatttgggggcactgggcatgggaagctaacaccagtagggtgcctcccacaggcttccagagtaagggagaagaaggaaccatcatccgtcactgggaggctgtggtgactgccataccagaggacaagggaggcagaaacagtctgaaggctcaaccgtgaacaatgtgtgtctttgaactgtgaacccagtgtgtctgtgtttgattccagtgcctttttcaggagcaattgagtcacaagccatgagattctgatgataaatgttactggaattcagagaaggaaagaacattgggatgtgctggaaccgttagagtaagtgaggttcagtgttggctttacaggatgggttagtggttggatagctacagggaaggggaagcattccaaagaagcaaattacaaagcaggagcttggcgagagacagtgggtcttgctatggtggttaattctgtgtcaacttaactgggttaagggatacacagagagcagataaagcatcgtttctgggtgagtttgctggggtgattctggaagaggatagcctttgaatcagcagatcaagtaaagatttgccctcaccaatgtgggcaggcatcatcccatccattaagggtccaaatagaccaaaaaggcagagacaggatgaattctctcttcccttcagctgggacttccatcttctgcctttggagatcagagctcttggttctcggatcttccaactccaggatgtacaccaacacatcccccacttccccacccaggctctggctcagactgggatttacatgatcagccctcctacttttggactcaggcagaattacaccacaggctttcttgggtctccagctcacagagggcagatggtgggtcttctcagcttccatgagcatgtgaacgaatgcccatgttaatgagtgtgtgcatatgtatacacacataccgatagattagatagacagatgatagatgatagacagatgatagatgatagacagatgatagatgatagacagatagatgatagatagatagatagatagatagatagatagatagatagatagattctctggagaaccttgactaatgcagttgggaatgaagtgagttgtcaaatctgacagaggtagtgtatgtagactgagaaaaattagaaaatgaagcttcaccagtagaacggcacaaaattataagtgaccattaaggctgggagagagagtttgatctttatgcagaagaaaatagggtgtggtatgcagaagggtggcatgacaatatgagtgatttagaaagcttatcgcagtgaaagatggattccagaaggaatgggtagagacagatttatcagttaaagagctgctgtaacattccaggcatgaagggtgaaagtctgagcttcagcctcagtagccagactcgagaagaaagggtaaattcaagagacactttagaagggaaaatgatgagcacagtgacagactgcctctagcgaatttcaaaatggcaagcatcaaacattactcttctctttgtactcattatgcttttcatctcattgtactttccattaattctttatgacgtgtcatttgagcaacaataatttaaacatttaagaagatgtgtgactatcattttctgagaagtacaatgagatgaaagatgttaaaagtacactgcatatagtaagtgctcaataaatgttcatgaagaaattaaaatttaaaattgctaacatataaatcctttcagagataagttttgggatctagagttgtcacacttgagttatacaaagcttgaagtcaagaacaaagaaatgggggttttaagcagtaaaatgttacaggagactgctttggaaattcaagaaaagaaattgatacaaacaactcgagagatgatatattaaaatacaaatgagaagtatcccatctaatttttataccagaggtatactattgaatcagcaaaattatgaaatttttatggattggtagtactagaatatactcaagagagctcagaaatgaaaacgtatctgtctagtgacaaaaaactaaaaatgaagttttatctctgtcaatgatttgtatatgataatgactgtattattattatgaacaaaagctgaataaaaataaagatattattaggtcacttcatgaaattaaatttttgaataacaagttaattataaatacaaatcttccaacatttttcgatccagatgattctcacaaaatttagagacaaatgtgttgtgcactgacttcacaattgaggaatggaatcaaaatcattgctcaaatgttaattataccattttgcttgttcagaaaaacatatctcagtaaaatctgatatttataagtttataaaaatattcacggaaattttttacaaagaaagaaaagccaacccagtcaatataaaaatattaattttataaataagaagtttgcctcttattcagaaaaatgtttttccccagaaaaattttacttacattaaacatcctaagcaaacagctgaaattgttttgaaacatacaaaatattgatgcgatgactgtctagtaaactagtttatttggaaattttcaatcatgtcattcatatagattctgaaattaaatacagaaaaacatctccaatgtacgtacagtttatgcactgttaggaggttttttctctgtgggaacaccatagggtacccttacccaaacctagatggtatagcctactacacatctgggctgtatggcatagcctactgcttaggcaatgagcctgtacagaatgtcactgacagcaggttactgtgctgaatactgcaggcaatttaacacagtgtaaatatttgtgtatctaaacatatctattataattttatgaaacctctattacatatgaggttcatcactgaaacattgttatgggaaacatggctgtatattcccctgaaatcattaattttcatcatttatatgctcagcatcatttatatgctcatttatatgattttatagagttgttcagatttagttcatgaatgctttcttcggttgcatcctacctaaacctttacagagattcatagctggaattaatctgatttttttccatagtacatgtttatctcctttacagcacttatataacaatgctgctatagatcagccttccctggcatgtgtgaggaattcattcagtatttgttcaataagcaatacattgaactttgaacacctcttctttcttctctggtaccctggatacggaaggtgctcagaaaattgattctaatctcttcatatttttgcagccctcagcaatgttaaataacgtgtttaaaatgagatacataatttagggttaaacttcttttttacacatattagaagtattttaaaaactaaaagagattcaaaccgcaatcaaatttgcctttgttttactaaatgagaaatgctaatattaggtttatgataaaaatattttatcaggaacaacagtaagtaaataatttttttaaaattttgacatcacttgtcctaatgttatatcagaaatcttatctaatctgttttttacctgccattgttctctgagaggaatacttgacataatgaactcaaaatacgactccatgtttatttttgtgtccttcctcagttttacttcagtgctcaagttgtttgtctctattttaaaacattttctttaaataaaaatgcgtgtacaaatcaaggttgaagctagatgcatctttcagtgatcattgactttatctgtgtctttatcaagaataaagagctagctaatgtcagaaccagggtttaatttgttggccggggcaggggtgggggaggctctgttttttcctattaaaaaatccaacactgaagtatcctcctgaatacgtacattgatatattgtgtataaagagaaaaatgaacatgtaatttgtctcctttaaaaattgacttttttagtataatgacacacacaaagtgcaataaggcaattctcccgaatgcattttctttgggcagacagatgtaagatgacttcaggagcctcaataattcatgcagcttcctatattgtcttttacattcataacactttaatctattgttccattgtcttgcttggccaatatagagaagtgatgactgaattcggtttgaagtctcagtcttttctcaccctggttttcttgtttctattctcccacaccaataaatacgtgaaacctaataaggataaaaaaattctgttgagagtagaacgatattttaaaaacacgaggtgtgacttctagagataggtaagtttagacacatgcgtgctgcatgccaatggacttgttatgctcttttttctcttcaattaatcagtactagaattataccagagacacatcttatagccagtttagtgacattgcttgacaacgctcacatacttactgaacgaagtttataatttttcatcctcatagcaccttctatccttattacaactaagtatgtcagaattgccttattatatatcacacacgaaaaactaattctaagagaagttccatcatttactcaaggtggcaggattactgtcttaatcgaaatttaaactgaagttttctgattaaaatcatgtgataatagcattactctctgggaactcacctgtcagaggtaacaacattttgtagctttcctaaagattttttctcaaggagaaaaatttagggttctagatgaataagaggttacatcttaataaccttcaacacatatcacctgtctctaaaaataagcctgtaattgtcagactcctgttgattaatttcctttgctgggaagacttgatcccattttcattgcttccctgctagcaaagccctgttcctgtcaaatcatgtgtattacagtgcttttgatttcctctacaattagtctagttttttaatgatagcggtatgtgcccatgataaaactgtagtctgcaaaataggaaatggtgttaagaacaacataagaagacttttgtttcccctataattagagcggtccaaaatggaataggctttctcctaaaagaaatatttataggtgtgctgaagctggtattgtatgacggcaggtcagaatggcaagaagaaaaatcctgcatcgactgaggggtggatctagattagtcttttctagcactttcctcgtaagaatcatctagggagtttgttaaaatacattttcccttggttctggctatctgtgtgtcagctagatcccgaggtcatttttacgatctggaagttttgacaatattgcctcggcagatgactaacagaacttccgcctcagcaaaagtctttgcactggggctaggaatgtgtcaagtgagagcttttgtgttttgcgttttttaaattagtattatttttattgacaaatcataattttatatgtttatggggtacaatgtgatattttgatatataacaatgtgaaatgattaaattgagctaattaacatatccatcatctcgtttaccgatcattttttatggcgagacgtttgaaatgtactcttttagtcatcttgaaatatacagtatagtactgactagagttgttctgtcgtgcagcagggggagggagggagggcatgggaagttgttgaatgaggggtacaaagtgatagctttaagttgtgattaagctgtggttcctagctcgagggttgaaaacagttgatggactgcaaagaatataaggcataaaaaaaaacgcaagaagatatagaaaaagaaaggaaaggattgaaggggtgggagaaggaagaaagaaatgaatgtaaggagaagaaaacatgaagaaaggaagagagagcgagaaaaaaaggaaggagggaaggaaaagctgagctcagatggaagaggggtatttaatgctcgttgaatgcatgtgccaaatttcagggataaattgggcagagtagaaaataaattaaatatgactcaaatccatagtaaaatataaactggatcccaggccaatttttttttcttttcatctactgtcagaaaagtaaagtttttgtagtagggaaataaggaacatttgatttttataaatctcctaaaacattaagaaatttttgagtttgaggtgaactaggaaaccaaatatcaaatatctgtctcttttgtaattatttcttgcctggctctcaacctactgtcttctcttttttaattaaaggcttcctgggatacatatgtactcatatttggtcatgatatcttttgatacaattataattcaaataatttaaattatcaaagaataatttccatttgtagagatgctgaacagactctaaggatgaccgtatgttccaaggcagacatgatccacacccaaaagcgtaaatagcttatatgagcagctcttagaatgacagccatatgcaataatcagctggacacctgtctctttgtgtttgcatacagcaaaatatacttagggagcatttctacatcacaaaaggaagttttattcagctttattatcaatgaataatatatcagaatacagtttgcatagtgccactcataccaaaattacagtgaattttcctcttgagatgactcagtctcaataagagatcatttgtctatatacatataacctgcacagaatgcaatttttgtgcataaatattaaatcattatgattcattttgtttaaggaactaaaaatacagttaaatctattattgtgcctaactataagagttttctgactatgcattacaatgtttgaatcaatataattttattatatgtatgttgttatacagtttaaaagtatgttagcttagagtatttaatatgtggcactcacagacaaataacaaaacgaagtccctagaaaatagcatgatattaaatgttttatcatgaataaaaaaatatttgaatagtgcttcatagaataattacctttctctgggtttataatattggtaaagtctaaagatcttctgattggaaaggaagataataatggtgtcttaagataacctcttgaatcttctcagaatcactcagaatgagacagaaatgctagagggttcacaacgagcatgctgttttgtcagtccccctcttcatccttaccatggtacagcagaaagttgctaaggatttctctcggtgaaatctgagctttgaccacattttgaagtcactccatatatacctttggaagaaatgccaaagacaatcttttgcaaaatttcttgtatttatttgtaactgaaaaatgattgagcagctattttgtgccaggatgtgggcaaggtattgagaaaaaagaaatgattatggcattaattatttttctccagcagttcacaatattctacaaaaaagagatactggggcaaaaccagaaacaaaactaaacatcagtaactaaatttttccacactaaagacacaaatgaggtaatatatacattaagacttaaaatttaaatacatccaagcccctcaagctttttcccacccagattatgccctctgcaaatcactctacagctgctgggatttgtttacagtggagctgggcacctagaactgttgtgaacatcaggtctggcatgtgtggcatagggtcagggccgtgcatgttcccttaggcttcgcatgctggtcaggatgtgcacatacttggccaagcctgtgcccagggcagcagtgtcctttgccctctgtgaagggctgactggcccggatttgttcagttcagcctgtttggtgagaaatctctcatggaccttttctcactggataaccacaaagagatgaatttagattatattctctaaatataatctacattataaaggagggaactggaaaaaggatgctggagttgaatttgccttccatctttttctacggtttccttgtgtcaaaaccatttctgtcctcatattgccctttcaaatgctaattacatttaaagtttttttcacagagcactttacagtttacaaaagtaattcaatgtgatttcatggaataggaaaataacatgttggtgtgaatatctgaggctttattctcactaagtacagggtacagatacagtaagtgaagctggtgaatatttgagagccgtgggtggtggtccgcacctgtggtcccagctacatggtcactaagtacagggtacagatacagtaagtgaagctggtgaatattcgagagccatgggtggtggtcggcacctgtggtcccagctacatgggagaccgaggagggaggattggctgagtgcaggcctggaaggcaatgtgctaggatcatggcgctgcactccagcttggcaacacagtgagatcccgcctctaaaacaacttaaattttttaaacaatgaatattttatcatagtaacagtagcaaattttaaagcatttattattgaccaggtatagtggtatagtgataagtaggtacatatattgttttatttagtgtttaaccctcaggaataagtatgcttattgcccttcacaggtgggaaaagcaaggcaaagagaaagtgaacaacaatgaaactaggaacgtaacccaagcgctcgtgccagagcgtgtatgctcgatcttgggaccacaccacttcccttggtaaattttcaagcatttagtatttgtgtgaaggcaatcatattgtgcagaggaatgaccaggctacaaaacacagtgtgtgggagaccgcttaatgctaacactaattctatgggtgacattcagatctataaaagattaagtgaatagagctgacttattgagaggggtttgttgtagtcgacttaaaaccaataaaagacaacatgatgtcttaaagtcacttcaagataaattaatcaacttataagcacatatagccattaagatcaattcactttacaaagattagaaaatgataaaggggcataaaatacaaacttactatctgagaaaatcaggttgtagggcttttctcctgcaaaatgaagtaattgtcagcaatgtccacttggtagaacagtgttttccactgttctcttcatagctttttctaatacgatagttaaaagaggaactagctcttcagacccaggcagttgaaaaccagctcattgggttccagctccacgggtccttctctacatgtttattgcacataataatgttcctcttggggaaaatatgctgcaatatccctctgatttattgtatttctacatattgttaatgtaaggactctggtattcaacaaagaaattatggcacatctgggtacacagaatattctaccttccacagaaaaggtcaggagagaaagaaaagagagaactgaaatataaacccttcaaattgaggtgaaatcctgactttgccccttggttggcatcatcattaatcactactaagcaactgcaattagaagagattaactggaacttagagttgctaaacaaaaagaaaaaaatagaaaggaaataaagctgtcttcctacgatagacaaaatcacagggccattttcttccattgatttttgctctcattaagatatattcatttactttccttttgaagcttgacgtaagaatcttgaaactagaattgtcttcaatgaattattttgcccattactcttcttatacagaggtgaattccagattggcttgggacaatgactgtttatgctttaaccatctccaaacgcaaataactagcaaaactctttatctcattctagtattaggcactccaagttctgcagcaaatattcactctgatgaccatatggaaaataacacataatttctgctttcttgtatcttaaaatcagaagatgaagccaaaacacaagataaataggaaatccaaacagtgaccccaaaattgtgttttgtgaaagaagaatagaaacacaaaagtggagagagagacctcattaggatgtgagtagcaaagggggttcagtgaagcagcagagcttccgttatgtttataagagggataacatttagagataaatcttaagatagagaaaaaagaagctgatgcaccaagaaagagaagaggagagcattagcatagtggtgcaggggctggaaccagcaccatgtgtttgtggaaacaaggaagacaggattatcagtcagcttctggaaggtatgttggaaagggtttcacaaatgtaaaagaggttattgataaatgggaagtatatacaccatatatttaaatacaatgtatttttattaagcagtgacctctttaaatgtaaagaatgtgtgctttctgacaaaggttgaatatccagcatcataaggaacttaaatttacaagaaacaaaacccataaaaaagtaggctaaggacatgaacagacacttttcaaaagaagacacacatgcaaccaacaatcccacaaaaaaaaggtcaacatcactgatcattacagaaatgcaactcaaaaccacaatgagacactacctcacaccagtcagaatggctattactaaaaagttaaaaaataacagagctggcaagattgtagagaaaaaagaatgtttatacactgggagtgagagtgtaaattagttcagccattgtagaagacagtgtggtgattcctcaaagacctaaatacagtaataccatttgacccagcaatcccattactggggatatatacgaaggaagataaatcattctattatagagacacatgcatatgtatgttcattgcagcactgttcacaaccgcaaagacatggaatcaacctaaatgctcatcaatggtagactggataaacaaactgtggtacatacacaccatggaatactatgcagtcatagaaaaagatcccgtgctttgtaggaatatggatggagctgcagaccattatccttaacaaactaacacaagaacagaaaaccaaacaccgcatgtactcacttataagtgggagctaatgatgagaacacatggacacacagaggggagcaacacacactggggccttttggagggtggagggtcggaggagggagaggatcaagaacaactactaatgagtactaggcttaaaacttgggtgatgaagtaatctgtacaccaaacccccacaaaacaagtttacctatgtaacaaacctgcgcttttactaaacttaaaaaaagaataaccacatgtgcccttaaaaaggaatgcacgccttatgcttagaattttagtaaaaaatggttaaacaggtggttttacatgcacacacattttgacagctaaatgagactaaaaggttgagtcctatggcagccagaaaacaactgtaattttatcttgcaacaataggaaaaaagttcatcttaaagtccacctgggatatcactattttgttttacaggcagttagacatgataataatcattcatctacaatatttactggtcatctactatagccaaggtacacaatttttgtaattcagaagcttagacaggtcctgataaaagactttcatacagacatatgtttatgacatatacctatggcatacatttataacatggtgtgtccggaattggtttcttccagtgggttcttggtctcactcacttcaagaatgaagccatggaccctcgaggtgagtgttaacagttgttaaagatggtgcgtccggagtttgttccttcagatgtgtccagagtttcttccttctggtgggtttgtgatctcgcttgacttcaggagtgaagccacagaacttcctggggagtgttacagcttttgtctggagttgtttgttcctcccaacgggttcgtggtcttgctgacttcaggaatgaagccacagaccttcacaatgagtgttatagctcataaaggtagtgcagacccaaagagcaagcagcaccaagatttattgtgaagagccaaagaagaaagcctccacagcatggaaagggacaccagcgggttggctgggtggccagcttttattcccttatttggcactgcccacgtcctgctgattggtccattttacagagtgctgattggtccattttacagagtgctgattggtccatttttacagagtgctgattggtgcatttacaaacctttagctagacacagagtgctgactggtgcgtttacaatcctttagctagacagaaaatttctccaagtccccacctgacccagaagcccagccagcttcacctctcaatagttataacagttaataagagcaatgttgaagatatgcataggtagaaaaagggggttcagtgaatttaatctgtattagggattgttaatgatgaagtatagtaattatatttagccaaatggaagagggataggtattctgcatagaaggcacaacatcaagctataggggcaaaaaactagtatttatgaagctacaaagagtttggtattgttggacataaagtagatgggaggaagaatgagactgacctatagaaaacataaagcagatgatggaaacctttatacaccagttaagggtttgcttcttgttgtctatgggtagccattgagaggtctaaaaaggggagaatcatgataatcgtagttggagagagataaccctgatggctggtaagaatgtagagagggaggctatttggaagttaagtaagaaggatggtcactcctaaggccaagatctccagcctcactggtctccttgttgttcctccaaccacacacccaccctgacttggtcctcctctttctgggacactcttctcccatttattcatggctagctcatacattctttaagtctttactcagttatgacttcatcagtgaggcctacactgacaagcccatttaaagcttgggatttttttttgttttttgctttttgttgtttgttttgagacaggatttctccccttcacccaggctgaagtgtagtggtgtgatcaaggcttatgccagtttcaaacttctgagcacaagtgattctcctgtcttagcctcccaattgcctggggctacaggtgcccaccatcatgcccagactccatttaaagttttaatctcctctacattcctaatcctccttatcctgttccatttatcttactctatcctgggtaccagcttctgatagccaatgtattataatcattgtttattttctgtcttccccaactagaattaagcttgagaaaggcaggattttgctttgttttcttggccaaatcaaactcaaaactcagctttaggagtgctagcacatattaggcattcggtaaacatgaacttaataaatgaagaagattaagatggaaggtccagttttttttttttgttttttttgtttttttgttttttttttgagatggagtcttgctctgtcacccaggctggagtgcagtggcacgatctcggctcactgcaagctccacctcccggggttcatgccattctcctgcctcagcctcccgagtagctgggactacaggcgcccaccaccatgcctggctaatttttgtatttttagtagagatggggtttcaccttgttagccaggatggtcttgatctcctgacctcgtgatctgcccgcctcggcctcccaaagtgctgggattacaggcgtgagccactgcacccagtcaatggaaggtccaatttaagaaacattgagactggtgaattattggatatggaggctaagagaaagagccaagaattgctccattttccagcatgggtgactagtgggttattatttccctaatggacaaagagaagctggagaaggagttgatgtagaaagaaggtgctgaattctgttttgaatatgtggagcttgtcatgcctgtgggatgtgctggcagatcccacagatttgtcccacagagatgtccctttaaagctcagagaagcagctaggatagaaaagaaaaatttggagtcatcagttcccaagtgatgtgaagaccctaaagtggaggggaggccagggagagtggtgcccgagatgacagtgtactaaggacaggattttaatgaatatcatgaataatgatagatgtatagtaccatgacctgtcaatagttaagtacatcttcctataagatgatttgggaagctaacttgtggtgatgacgtgacctgggacaatcccaagaggcaagggggttggttgaattatcacagtcctcacagctgctcaagcttctgtttgtgtgtcgccaattatgctgaaggatctagaaagatgtgccctccctgctcctcctcaggcttagcatgcactcagtggtttctgcagcaaagttgcaaactttaatgctctgtatttgtcggcagaaataagacccaaattcctaaacgcatttctaattaaactatttgattctcagctaattgatattcaattagcagatatccctaaaatgactaggacactggggccatgtagcgatgttctggaatgtgactttgaaagctgcgttgactttagaactggctacattcattttggctgaagaggtcacctagagtataggattaaaaggaaagtgtatttttaaaaatattatgcgatatttaaaaaataacatactttaggttcaatattattttatgactcacacatgccatatttgtgtgaaaatcaagaggcattctgaaatcattcgattctttttttctgcctgaattttttactttaaaaagattattatgacattccattagtggttttgacagagtgatattggattctcaaaatgaaagatgtgtgtgaaatatcagacttgtcttatttttgaaataaagacagtggcccctctcacctggaagagtgctgtctcaaacgattagatcctggcagacaacagagaacaaacatattttgattaaattatttttctattcaacctggtgcagtgcgtaacctctatgtctatggctctttgtttgatcttttcatggaggtgagtgattttatttacaaaatagaggccaagagaggaagttaaaatatagaatgatttgtgtactcatggatatgcaaaggaaggtttgaattagtcagaactacatttagagctaataagctactaatgtctaatgtctgcctttgagaatctgttttttgtttttgtttttgtttttttgtttgttggttttttttttttttgagatggagtctcctctgttgcccaggctggagtgcaatggccccatctcagctcactgcaacctctgcctcctgggttcaagcaattctcctgcctcagcctcccgagtagctgggactacaggtgtgcgccaccaggcccagctcattttttatttttagtagagatggggtttcaccatgttggccagcatggtcttgatctctttacccctgattcacccaccgtggcctcccaaagggcaggtattacaggcgtgagccaccgtgcccagctgagaacctgtttttaagggtaaacaatagtggatggtttataatgaagggatccagggtaagaagctatcccgagagagttgagcatccccaaactaggggactgagtttcaggatcctgagctcccagcagcagaaagttgtcatgttggtgacacatggatatgaatggcctgtgcagctgaaaaaggttgagaaggcagttggctaaaatttaaattgtcatccatgtaagtaaaatgatttgtgcagtgatgatcatacctggaaaaagcagtgctgggaaaaatagagccaagaaaaatgcgagcagaaaggcataaggcaagagactcgtcgggcacccagaccagctactcacagtggtttattctcttgaggagtcagaatggggcctggactcaatatgacgttttcacagggcattgagggaactgcaactgcaatgtgggttacttgctcgccgcatgcgcagcccaactaacaagagcgaagtttgggtacgaagcaagtgagcttattccgaagcctgcctgaggaaggggcacagcgtcctgcctttaaatatgccacttcacctttggagcagaaagtggtacttttataaggtagtggaggaagtgagcaagagcagggtcccccttgctagcttggtgccttacgtaccaggcaattgagttggtgccttcctgggcagaaataagttgtcaaagtggccaagtggacttgcttttcacatgccctcttggtggatgaaagttccgaggctgcgggggccgtgctttggtctgcaaattaatagactgtcaactctccaggagagatccctcttggagcacagagttaaacttgctctgcaggaaatgtctgcggggggtggccgtgaaaggttgtgtttacatttccaaagggctaagaaacagggaaaaggtggaaaggagaaaaaaagagaaaataatgtttaaaaactatctcttagaaaaatgtgggtacccggttacagaaccgcctgtggggccatgcatggggattatgaagacggggttgccacttactttctttgctaagaacttcctgtcatcttcccatcagcagcgagagcactgggaaaacttcttaccacctcactgcccgagagcctcacctcatccaaacatcaacaaatccagcctcatttttcagaagggccaccttagtctttccatgatcacaagtgaaataattaaatgactaaaagttgtacttgtacaggtcacagccagataatccttcatttgcagttaactaaacagcatgctacacaattggatgtaaggaatgaaggtgacatagcaattttccatctgtattatctgagaccatgttattggaaaacggatggtcctaaaagtagaaatgaaaagttcacaagggcaatgatgggaagttgttttaatgggatcctaaggtctgcttctactaagcaggaaacagagagtgaagcagttactattttcttgctcaacaagtgaaagcaaaaagagaaatccacgttacagagaagactgaaacagaatcccataaaaatgtttctcagtatcatttctcagaccaaccaaattgttgtgtttcttaaactgagaagttgaaataccagagagaggtcagaattctgctgagatgtattagaatggttgaggtttggcctattggagttgcagagattcttctgcttaagacctcttatgaatgtttgtagataataacagtccctcgccagaggcttagcttgtcacctctgcctaccatcaacagatgctttcctgatcacactgttttttttagccttagccactttgctctctcaagcagtggctttcaaggtttttgaccacaatcttctgaaagagacataactacatcttgaaatgtaagtgcagaaatgtatactttcagtaaaagagtcacaagacaatactactttggcagatactttaatatttccttttgtctattctattctattctattctattctattctattctattctattctattctattctattctattctattctattctattcttctattctattctattctaatgctgatcccaacttaccaatgtttgttcatgggcaacttacaggctgtatgtaatctgcagtatgaaccacactgctttaagctttttttaaaaaaaaattgaagcagaatttacttataagcttatttcttagaaatgaaaccaaaaaattaaaatattttatagaaattaaataaaataagaatatagagcagcgatagtttctggtgaatcttaactaaatattaagctacagcttaatgttcaacttatcaaccatctgagggataaatagggtcagtccagattaaaaatttctattacactgtataatttcggtctgtgtttacttgttggtgtatttatatacagaattaatatttctaatacaaattttcttactaattataattttactttaggagacaagatatatttttaaataaacaaattcactctacataaatataaccagagatttattttcaaagaagttaattctggaaggcattatgacttttatctttaatcatggaaacaaacttttgtggaacacctgtatttgagacataggaaaagacttcctgataatttttaaaaatccatttcagtttttaacacctacgtattttttcctatgtgcaaaatatctgaggaagaaatcaaaatagttaaataatccagaaattacattcagtcaataatgtcaacttaagacaaactgtgatttgggttgtattttataagtttgtttttccttttaactgaatgtatacgatgatttggtcaagttgcttggatttgatttatgctgaaataacactcagaatcaaaacaaagcttggtccaaattccagaaagtagggtaattccctaagtgtaacctgattgaaaatatatgaaaatttactctcatgtacaaaataaccattatggtttaggagaaatagaaattataagctaatgaagatagagacttggcaatttactaaaggatccaagagtatttatagcttattttttaaactgattaaaaatgtgtcaaaatattacattctaaataaaagttttgattaaattatttcattcactagctttgaggcatggttaaagtgaaatagagttcaaagaaagggaagaagtaaattgctaaaagagtaaaaccaattttgatgaattaagtcatagttaaaagagaaaaagaaagacaggtgaaaataagattaggctagaatagaagaaaaaaatgagaaaaagtctaacctcagtaagtaactagaaagtaagacttgagattaaataattccataggtatgtcatagttcaattgtacatttcatgaaattctaattctaatttgatgaaagataattccaggaaatttgcatgctattattaaatcactttaagatttttctccaaatgtgttatattagatatacatatatgatatatgtcaatttatatatatataaatatagctctctcctctttgagatatatacgattttagtaggtttctgaggtcactagttgtctccattttctctgcacttaaaatgatgcacagagtttagaagagaagattgggtgagagctctgcatctctaaaaacagctgcccttgcccggatcatgctccgcaaatgttctgacctaaggctcgaatcagatgcataggttatattgactcaagtcgaatatctatttttgggtttaagtgcatatgtattttcaatggcaaattaaagtttataaaatggaatatgataaaagataaatgcaaaaccaaagagaaattgataccttgatattttcagtgaactttatcaaaattcaaaattgaatatatatatttatttaattatatataatatgtatatatatgaatatatagagatatagatatccatatacataatatattatataaaatatataaatatatatatatatataaatgctacataaatatacgacctcagacttctaaagctgaatataacaatggaattaaaagttaaaaattagatcttctgggcatcttagaattttgaaatctttgaatataggaaatttagcaagaactttaaaatgcttaaatggttttaccattgtattctgctggattttattttatggtaatcaaagttgtcagaaggtcagagactcataaatagagaacagagcatcaaaaagctcattgacaagcctaatgcacatgctgtctcttctttaaaaaatgaataaagatgacaagaaacattttgctcttcttttgtaagacgcagaataaactgtcatcttttctcttatgaatagaaaatgcatgacataaaataggaaacaaaaaatatagaaacgtagaaaatgtgtcataaaatagaaaacagaaaatgtgccatctcatgtactaaatttatctgatgacatcgcaaaagaaataacctagtcactgagtttaacattttgatgtcttatgtaatcataaccattgacatgaactttatatgtgttttctgtctatcaaagttcatggtcatgaaaaaaaacgtaaactatttttactaacatttttaaagtgaagaagaaagccttattgtataatttatagtggattctaacttcattgccaagaataatacattatagtttcttagtcattttcattatttgtaagagtgttaaacaactcctaatcattttacttatttttaaagttaataaagcaatatatgtaatatgtaaaaacattttccatgtaaagttaaatttagaaagtgtaaaaattggtgtgtcactgttcacccttattccgcccttgctccctcaagttctgatttcccagtaggaattccataaaatagaatagcttattagaattgtagttgatatgcaattaggtaaaatgttaatttgagcacaacacatctttataatcttgaaccttcctctattactatagttttattattatttattagtatgttttttcatttattcagatattatttctgtctctcaatgtggttttataattttcttgatataaattccaagaacctaaaatcattgctttatcaccttttgatgcttttggacttgtcacccaggtgaaattcattttgaactacagataaagagatacttgttatcaataattgtgactgtctgagagttcactctctttacaagctagctgtttagcctgttccattttcatgactgtttcaagacagcaggaggttctgggtcagagacaaagaatagtttattactggaagcaatagccagtcacttgactctgggtcccagaagcctaaacacagggcattgtgaagagagccaggtgacacttgcctgccaagtagactgtggtacagcacaaacgaagctgtgggaatctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctggaagaggtttttcagaataaagtgcagttatggtctcacaagatgttaagaaatgtgaattgaagtaaaagttctgtgatatattaagctatgatatactaaaacttttagtttgcatttttcatctgtgaaaagtctattgaatctttttcctgtgtataaatagattgttttctatgtaaaagtgaatttttggtttcggtcattgctaaatacctagtgcctgttgtagtgtctacacatagtagacactcaaataataaataatatttgttggataaatacatgaactaaacaagtaattcatgtttttttcttggttcctaattttttcccatatatatgtaaaatatatatgtataccgtatatatatatacggtatatatatgtgaaatatatatatatggtatatatatgtgcatatatatatatggtaaaaaagaatttcctttgaattatctataaattgggtggaggggaggtgcttttcaggagggccacagtgcgaggtatctttcatgccttccttataaacacatacacatacgaatatttaaaaagtataatcaggacaatcaaaactggcatgaggtattataacatcattgtaacacctgtggaaggaaagtaaatcttagggcccctgaaccactaagctaaaggcaaagtcaagctgggccaacctgcctcccattctgttcaaagtcagcccccctgctcactacatcaatgcatacttgactgccctctttggggaggcgcatcagaaactcagaagaacgcagccatttgtctcttatccacctatgacccagaagcctcctccccacttggagtcctcccacctttgcttctagttgtcctgcccttccagaccaaaccagtgctcatcttatacatgttaactgatgtctcagatctccctaaaatgtataaacaaaatgtgctctgaccccctcgggcctttctctctgttaatgggcttgtcctgaacattggcaaaataaactttctaaattcactgagacctgcctcagatattcaggattcacacaccttaatttcatagacagtaattaatgaataaaatgatctttgtcaaacacaaaaaaatgtatgttctcattttcttaccagaagttttagatttttactttgagggtaattttaaaacaccaggtcatgtgattcatggtctaacctcccatgccagtttggtagtctatgacacaatttcactcaactacttttcactccttgagtgttacacgtgttctccccgtcccctctctgtcttgtcttggatcagtttccaaacctctgcacctaagggctcatatctttatgtaatttgttcctcaaaaaaatattacatgttaattcttctaggaaatcttccttgaatacccatcaaaatgagtcaagggtccttacagtgagctcacctaccaatctatataattggtaatcacagaactcatactaccaaaattattgatatgtttgtttaaatcctttctggagtatgtatcacttggtatctttagcatttatttcaatgcttagagcatcagaaatggtcaatatggaagaaataaataacctcctgagtgcttggtaatagcagcaatatgcgttaacatttgagagcccctgtgtgcttattcattgtgacgcctctcactccgagaacttgtacttggattggccattgggagtttataattttttttttcataagagtctgatgctttaaaagcagctaccatttacttaccactattggaataattttaagtgtaaaattccatgaaagctgaaaactgagtaaaagagttgttcccctcaaacgggactgaagattagggaggtagacctgtacaagaaaaaaagacaaggaagtgggtgagaagtagagtaagggtagagaaatttgttgaaagtttcatttatataataatataaaacatctgtatgatgccattagaataagctgtaaattctgttaaaaaaagacaactggccaggcacggtggctcacgcctgtaatcccagcactttgggaggccgagggaggtggatcacgaggtcaggagatcgagaccatcctggctaacacggtgaaaccccgtctctactaaaaatacaaaaaattagccggggtggtggcaggtgcctgtagtcccagctactcgggaggctgagggaggagaatggcaggaacccgggaggcggagcttgcagtgagccgggatcgcaccaccgcactccagcctgggcgacagagcgagactccgtctcaaaaaaaaaaaaaaaaaaaaaaaagacgactaacatgaaaattttaacatgattgaaattttttttttttcgtttttactttaaggtcatggattttcttctgactctggacctgctgagaagagttctgtgttattttatggcacaaatcatagctaatgtattatccaaaatattgtttaatgagaactaaaaacataggaatttgggtgaagaacaaatttcttcacactttttatgattccttatcgacacctcctacccactaattcttcaatctggccaacaaaaatttgatcacagatatgtttgcttcacctttaaagtctttacaaagcacttaatctagtcttaaatacaactgttcacatgcatttcgcatcaatttatatagtacttagttataacattacaataataaatacactgcaaatcaggtttggtaacacatccacttatattaacaatgccctgatgcacgttcaataattttgtcttttcaccctcaacaggtaaagaggagagagagggagagagaaagaaacactaaatgtgttttataagcaaaatcagctgttacatcatgatgattgttcaaacagctttcttcgctgatacaattgcaaaaagattataatgtccagtcaattgcattggcctaatctagagtataagggttttgcttctgggaatttgtgtttatatataaagtaggttttttaagttagtatatattgaaaataattagtggcttaccataatactttctctaacaatcttctgatacacaatatctcttttttctatattaagcttattaaatttgttccctaggtacttaaaatatgtcttatattccatatagcaaacctacaagatggatatgaatatccttattctgcagattagaaaaatgaggacaatgttgtcaagtgactgaagtggacccataggtagctgtttcccaatactattttgaatctcagttgtatgctctgcattttcggctcaacactaccacctcctgaaaagacttttaagcagaatttagaggaaaacaaatcaaacacatcagaaaacatcaaagcaaatgcattaaataagattatactgaaataagttggacacactgtggagatttccacttctgcccatgaagaattaacagctacagaaattgctttctgagagtaaatgactagaaacctggaaaaaaagatatgaagcaacagttttaggtgacaaacagcacaagactaaaacacctgatgggggaagaaaacaaatgagataagatttatgtctggaggaattttctatagcaaagtgaagggaacctgaactaaagcccagcagtggattgaacagcttcaggatttcaggaggctgaggtaaccacagcagtggattgaacagcttcaggatttcaggaggctgaggtatccagaagttgaaaggtaaagtactttggtagaataagatacataccgggagaactttcaagatcttcagaagagactcttccagttttgcttgtttgttttgttttgttgcaaaatagagatgagaggaaattccatgagactggggaaagaaagcagtaggcaaaataattctacggcaactgcattaggaatacttcatgtcctatctgccagaatgtagggacttcttaatatatggggttagtgtagaatccagaaaggacacatcccttagtagaagggttaaattagttaattgtgctaaactagcacaagaatacagatgttctagacccaacctaacaaagctcaataggataaagtaggataaaactaacccataaggttcttacctgtgtgactaaacaaaatccaaaactctttaaaaaatgtaaaaaaaaatagcacaaataacataaaattcacaatgtctaccacccagtaaaaaattaccaggcatgcaaactaacaacatttggctcataaccgggagaaaaataaacccacagaaacatatgcagaaataacaaagatgatcaaattagtaaaaaaggatttcaaaagattattataaatcttatggttatgctcagtgaagtaaatgaagataaacataatatggagaaaataaaagatataaaaagactggaatggaacttcgagaaataaaaaacatgtcaaaaaggacaattacattcgattatagaaaaagcatctaaaagattagcaaacttgaaagcctaccaatcaaaattattcaaaatgaagcacagaatgcaaagaaaaccaggttgaacagaaaagaacaatctttcattcagttttaagacaatatttagtggtctaacacatttgcaattggagttctaatagataatttcaagggagaaaaatatttaaaaatgtatacccccaattttgcaaatttatttgtttaaataaaaacaaattgagcacataaacacaaaatatctgaaaaccaataatatagataattttaaaataaaccaggaaaaaaacacattatatacagagaaataaaaataaatgtggcagaaaattattactagagatcacatcaaccagaagtaaattgcatggcctctttaatgtgctagaaaatgttagctatgaattctatactcagtgaaaatatctttcaaaaatgaaggtgaaataagatttttcctggtcaacaaaaagagttttatcaaacataggcacaacaaatgatgtcaaaattgattcctcttgcaaaaggaatgataacaggctgactttctttctttctttctttttttttttttttttgagactaagtatctctttgtcacccaggctggagtgcagtggcggggtctcagctcactgcaacctcttcctctgaggttcaagcgattctcctgcctcagccaccctagaagctaggactacaggcgcctgccaccacgcccagctaattttttgtatttttagtagagacagcgtttcaccatgttggccaggatggtcttgatctcctgacctcgtgatcagcccgcctcggcctcccaaagtgctgggattacacacgcgagccaccaagcccagcctgacatttttacctatgcaaaggaataaagagcaccaaaatgggaaaagtgtgagtaaatataaaacaccctgttcttaatttttagcctctttaaaaagaaaattgagacttctggttctgtataagaagtttgaaagtaatgagggagaagaaaaggaaaaatcagttaggtaaacagttaaggctggtcctcggagaggcagcctgcctgaaaaatcgcagctacaggcaaaaatagagcagcctggggaaaactcaggatgcacctgcacagacaagcacgcaaggtccggcacagaagccttttgttcttcgtgtgattaaccagctcccagggaaaagtttccccttcttttcagacatgtatgcagtgggctcggtgggaacttgcacagggaggagggggcttccctaaaacaaacccacagttttacaaacaagagaagcggtgctttgtgcttgcctagagtcatacccacagctacacagacaagggggagggagttgagcagacagcttttcagatgaagaaaagttacgcaaacagctacagaactgagaggagtttcttatacaaacttttgggattcaactgtaaaaacggaaaaccacttggctccccgctcccctgcagagagctttcattttttgttcattacactttcactccaacctcaccattttcattttcacccatgctccttaattttctcagtcatgagacaataagctgagataacaccttagacaacaagttaggacaaagtgtccttttgaaacagacaatgagatgcagaagggcactgggctcctgtctttccagggcaaggacaagtcgggctcagctgtgtgcaacttgttcactaaagggctctgtgagaaacggaaactgccccttctggcatgaccaagggaagatgatggtggtgtgtaagcaccggctctgggggctgtgcaagaagggcgaccactgcaagttcctgcaccggttgacctcctgcgatgcccgaatgctacttctactccacgttcccgcaccagttgacctcactgtgatgcccaaatgctgcctctactccacgttcctacaccggttgacctcaccgtgatgcccaagtgctaattctactccacgttcctgcaccggttgacctcaccgcgatgcccaagtgctaattctactccacgttcctgcaccggttgacctcaccgcgatgcccgaattctacctctactccacgttcctgtacctgttgacctcaccgcgatgcccgaatgctacttctactccgtgttcctgcaccagttgacctcaccgcgatgcccgaatgctacctgtactccacgttcctacaccggttgacctcaccacgatgctggaatgctacctgtactccacgttcctgtaccggttgacctcaccacgatgccggaatgctacctgtactccacattcctgcaccggttgacctcaccgcgatgcccgagtgctacttctactccaagttttgtctccgtgtaaatatcgccatgtccccagaataatgtgtctcaactatttcgtggcttctgccctgagggacccaagtgccaatttgctcatcccaagatgaatcttttattcaacctgagttacacgaagtcatctccaccatacccctttgctgttccagatatttaaatggtgctcaggttaacaccacttatgccagcgctgcagctctttggatacacagagacaaatgtagggatccgagaggccacttccaacgactgttgctatctattgcctctacagattattctgttctatttttattttataagtttagaaagagagtattaagcactaaaaaagaggacactttgtcctaacaattgctaaaaagctaaactgaaaaatgaacttttctcagattcattagagaagtgaagccacggggaaaaggactgcccctatattggagagacagaaaggccgatacaggaatcacagtgtgccagagcagaaagtcaagagcaagaactctttgggaatcagtggtggaatctgaactggaattgacaaatttctgtaaggtagacgtggacaagtgtgagaattagaacccccaggaggacccagtcatagagaagcagccgtacatttacatcttgtatctccaggagtttcaccaggacctgatattgaagattagggaaaaatccccttgtacttccagcagggggtggggaaaaggaaccccaggttgaaataggaaacagggcagaacattcagttttggaaaagatttcccctcaagagaaactaacagagccaaacctgctgggattttcttagagcctaagtgaggtgggcaaggggagagtcccaaccccagctgctcaagcttttctgttccacttaagaagaaggggagggtggccgggtgctgtggctcactcctgtaatcccagcactttgggaggctgaggctggcagatcacgaggtcacgagttcgagatcagcatagccaacatggtgacattccatctctactaaaaatacaaaaattagctcggcgtggtcctgggcacctgtaatcccagctactcaggaggctgaggcaggagaatggcatgaacccgggaggtggagtttgcggtgagctgagatggtgccactgcactccagcctgagtgacagagcaagactctgacttgaaaaaaaaaaaaaagaagaggagggcagaagatgagaagcattgtggcttcccagaggcatagactcactaaagacagagctaatcacagggctgagaacacttcaaggctcaccataaagttctgcgttcacaacagtgtggtatttctataaagataaaatgtagaataaaggaacagaatagagatgtcagaaacagacttatacgtagttatttttcaagatgttgccaggtaattaacaggaaagaatagtcttttcaaaaaatgatgcaaggacattgggttatttatatgaaaaagaattcatttcaacccttattttataccatttaaaaaattaaatttacatggattattaaatttatgagctaaagttcaataattcctagaagaaaacatgaccttgatttggtaatcatttcttagataggacacaaaaagaacaaattataacagaaaattgataaattgaattagtaaaaatgggaaaaaattttaaatgacttttaagaaaaggaaaggtaagccacccctagttcaaagaaacttgcacagcaggtatctgatgaaggtctgtatccagaaacataatgtatcttgattagaagaaagtaatcaactcaattaagaaataaggaaaatgggtcgggtgcggtggctcacgcctgtaatcccagcactttgagagcccaaggcaggcggatcacgaggtcaggagatagagaccatcctggccaacatggtgaaaccctgtgtctactcaaataaaaaaaaaaaaattagccgggcatggtggcacacgcctgtggtcccaactactcaggaggctgagcagggaaatcgcttgaacccaggagggggaggttgcagtgagcccaggtcacaccaccgcactccagcctgggtgacagagcaggattctgtttcaaaaaaaaaaaagaggaaatggggaaaatgtttgacacttcactaagaaacgtgtataaatggctaataaacacaagaaaagatgtacggtatcattaatcattagggaaatgtacattaaaaccaccaggagtcaccaccacacatgtagaaagcttaaaccttttaaggttgacaaacctcaaataccgatgaggaagtaaaacaaccaccattctcagacattgctgaagagaatcagaatcattcggccactttggaaaacagtacacatcatgctttacagaaagaagtggtatagaaatgagcagaggcactagtgtccctttaggaccattatattctaaagtgccaattggtaaaattattctttagttctacctggaaaatctacttctataatttaacttgtaattctgatctatgatatctttcagaacacgcctatgtgaacttaattaaatcttggtccaaacatgcttatttttatttcttctttattttatttatttttacttattttttaaatgagaaccaggataatgagatatttcttcttttacaagaatatgaagtttacctttcatttaaaacagtactactggcaccttgtcatataaaattttacatggagttacatattctaagaacagctatctgagaaatgtgtaatttctttttcaatagttttttatgtttattatcctatgatgtatgtgaagacatatttcatatgtaattatgagattatacttaattatatttccaaaggtgaagaaatttttgtatttttattttaaaataacaatagaaaagtatttgaaatatctttttaaattctcaattatgattcataacatcttatttttatttcacttcttacttttgtgtcttttttccttccatccttcctttccttctttcttttctcatttggattatttttaactggtgcctcagttcttcttaagtatatagaacttctaaaattataagcagagaatggtctttggttcccagaaaacttagattaaagagttaaaagttactcattatcatatagagttcctcagcaggtcattttgtaatgagagcagactcagtattataatataaacctcactggtcctgtattctttacaatgaacaaccaaagaccctttatgaagcttgatatattttaaaacattcaacatagttttatttcatgtccttgctattttataaacaggccttcaatagtcacatgatgaggacttttgggataatctacctgaaatgtaccactctgccctttctgttcttctgcaaggcaaatctgaggaattttttttattgttcatttttccaagaattcctacaaactgatgtctttactgcctacaaagtagcaggattttaaaaagtcagataactctgtttgcactgatatggccaaatatttccaattttcaggttaattctccactttttaacccagacaaacaaacattggattagattttacaagatgtgcaattaagaataaatgacagttgcctctatatatcaaaaccaagcacggacacaaaaccatgcttgcactcagtcttctctgaagaaatcacattactcttttccttcttcctatttggttacttttatgaggaatgaaaccccatgttgcaaaaagaataaagaatactcttcaccattttttttttaattttgcaaatttataaataaatgggtacaatttcttactaagtttctcattttcagcctaggcagagacatacttgcagctatcttatttatctcagagaaaccagcaatgagagctttaagcctagcaaaagtcagaagacaaccaataagagattttggcataacattaaagatagaccaagctaagacaagaacgaggatttttttcaatatggataatccaggaagaaaccgcaagaataatgacttttaaaatatccaaacaaatgtaaatttctcttccccctaacccttacagaaagcaaacagaaaacatcaaaaccaattgagaaactccaagtaggcacaagcacttcaaaattaatacagaaaaggctaactttataaaatgagtaaatttcgatacagaattatattcacacaatgaatcaggattatttccaccccatacatggtctttatcaagagaaagggatgtaaagaatatgaacctaaacatcaccgttttctattttaggtgacagcattctgtgactcactagaattagaaaacagtgacattagaattagtgacaattagaagggaaaggaagaaagggaaagaatggcatcttttacttactcgtgataaaagcaacaggaaggagttggcatcagggaagatagattggacttaagctgattctcactgctataattatctactgtgtctggttttgatcctgtttactgtgtgatacttgatatcataatgaactgttgattgtgtttatgaacatttgcaaggtgctcgtttgctgctatttttcggttagaaatgttgttttgtgtgccaaaaatggcttgaccagctgaaaataattctatataatttcaatttaatagagatacactttcctaaattcaattttatgcagttttgttacaacttgctaaaccacaggaaaaagggaaaaaaaggacatactatgtatataattcccttcaaccacttcctctgcttgtacatttgttgccagaaacaattttatgatttgcgatcggcaatagcattttcaaaaaatggtaatttttttcccaaaaattaccaataattttttattctaaaagccatgacaacttgacaaaaaatatgttaaatttctagtctctttttaatgcaaatatattaaaaactaaaaatgaatttgtactcaaaaaatttctggcacagtctcccttaagaaaatccctaattggatagaataggcatgttcccataattcactattattaagaaactattggctgggcgcggtggctcacacctgtaatcccagtaccttgggaggccaaggcgggcagatcatgaggtcaagagatcgagaccatcctggttaacacggtgaaaccctgtctctactaaaaatacaaaaaattagccgggcgtggtggcaggtgcctgtagtcccagctacggggaggctgaggcaggagaatggcgtgaacccgggaggtggagcttgcagtgatccgagatggcgccactgcactccagcctgggcaacagagcaagactctgtctcaaaaaaaaaaaaaaaatagaaaagaaactattagtgagcaattaataccctagctggatctctccatcaacaacatttagtgaacatcattaggctgtgcagcttggagaaatgttcagaattatttaaaatttatccatgatgaagaataatagaattagcaatgtcatcattacctaggtacctggcctttaaaaacacaatattaacaattttatttcttcccaaaatgttgccccttttatcagtttcctgattgtgttttcagctgattttagttatttggtgctatgtaagatttaaggggtgtgtgtgtgtgtgtatcacagatattgaatgcatagcccaatgcccatatcttagttattgatatctgtataacatttatgcagaactttatggcttaaaacaacgggcacttgttatcccccagtttctgtgggacagggtttgagtcgctcagccagatattactagtgccagctcagggtctcctgtgtctgcaggtagaatgctgtcatgggccacagtcatctcaaggctccactgaggctggagcatccccttctggaactctcatggctataaaatgaagaagtcacttggttgctgttaccttgctgtgtgaacctctccacaaggttatttgagtgtcctcactaatggcatctggctttccccagagtgggcaaactctcaatagaggacaagtgaaggggaagctttttatggcttagtccctgtagtcaccccgccgttccttacacgtattcattggaatcaagccactacgtcccaccgatgttcaagggaaagggacttaggctctaattcttcaaggagaaggtgtcaaggaatttgtgaacatatttacaaatctttacaataactttttgcatacatccatgcactggtataacctagcatttatgctaataaagtgttatgtgcatgcttttggttagtgtctagatagaattttttttgtgtgtaatttactttcaatccatctgtgtccatatatttataatatgtttcttataaatggtgcataattggatcctatattgtatcctgtctcatagcttttgtcttcaagtagaatgttttcaccccttatactttttattttcttttatatatatactgctccttgcagagcagggatacccaataggcagtgtgccaagagtagcccaacccttatactttatgccattgctgatagagtgggatttatatagagaatgtttcagtttattatctatttgcactatctaattgttactttattctactgttattgccttcttttgaattaatccacttctcaatcttccattttatcccttctattagttgtttacattataattctagtggttgctctttacggcatgcacctccgacttgatagagtgtactctaaattagtataatggttttagcaattgttaaaaagtgtatgtggcctacaacattttaactccacttacagtcagtattcttttaaagttacctacacagttgtccttccttcattgctagggttctgcccctccatcttgaatcattttccatcagcgtggcatatttcctgtagtatttcttggtaattcagatctgttggtaaactttaaattttctcaatttgtaatttcttaaaaaaagttgtcatttggccttcatttttggtggttattttagcaggatttagactttcagtttgacaatatatttttctcctgaacgttacagataccatttcattcttttctgtgtatttaatttgttcaaggcaacaatactccttaaaagatgatgtgcctctttcctatgaatgtcctcacaatttttctccttacttttgaattacagcagtttgactacgacatgcctatgtgtggttttatttgtatttatcttgcttgggagttgctgagcttcataaacacatgtattttatcagttttaaggcctttatctctgcaaatactgctactgcttcactctcttggtccttcatcattagaacttcagtgcacatacatgagacattccgatcacatattttatatgtctgttgtgcgttgttttcttcttttcattctttattctctgtactaagttttggtattttctactgacctactgtagagtttattaatattgtcttctgttgtgttcagtctgttgttaaactatccaatgggtctttatatcaattaattcatgcattgaatgcacatcagttattatatcttttggttctagtgtatctattttttcttacaattccacttatacatcacaattcttccttgttcatttattttgtctcctctatttaacatatttataataattattttagttattttaaaattcttggcgtaattctaatgctattgtcgtcaatggacctactgattttgtttttttttctttgaattattggtcacatttttctgcctgtttatatgtatggtaattggctatttttaattttatacctctgacatatataaaagatggcagattattttaattttccctagaagttctcctcgttcctgtgtgaggaagatagggtgacaagctgatcactatgatgtaatcaggtctgtgcctgaggcaatttcagcaccactcagtctatttctagtttgcttctagtctgtgaatgtgcctttcatagaattttttaattgagagcctggcaattccctatctcctcaccccaccaagcaaagatggaaggatattcattattgtctttggaggatttttcatttagctcttgagattttactcatgtggctaaaaatctgacagccatcttgaggggagactggcagtgtgtttgaggacatctctcctccgtgcttcaaacacacggccagactaatcctgtcagactaatcacagtgcatctgatgagagttgattgtaattggggttttattttacattttccagttcactaaagagttggcatttaaaaaaatcatcctctcgtttataatttccatctctcagttgtaatattcttgttcttttcttttacccattttaaaattacattttctgtcttttccttatagatttgaggatctctttatatattctggaaatcattcctttgtaaattatgtcaaaagcaattacattatttccaagttcatcttgttcttttattctctttgtgatattctttaataaacaataatttttaattcgatatactcaacttcatttattaactttacagtatgttctttcttttacgtcatgcttaaaagaatttcctacttcaagatcgaaaggatactttcacttttttgtctttagtctccttgaaattgagttttgtgagtagtactaggcaggagtctaagctctttcgtttactcttcaattttccctccctcttgccctttctccatctgtcccttccttctttcctttctttcttccttcctttcctccattctcttttgccctcctttttgctcccacattctccttctccctgtccttccactttatccctctgtctctcatccttttcttttcttcttgggtcttatctctaattgtatgatcacaatttattggaaggctcattgtttttctatggttctgcacaaccatggcagtcctcaattgtctatatgaggtaatttcttggctctttattctcttttatcatttgagtgttaatgtttcattaccatactgttataaattttattatttataataaattgataacaaataattggtaaagcagcccctctcaccttgttagcattcttcaagaggattttgataattcatgaatgtttatactttgagatacattacagattcggcttataaatttacactgaacgcgtattggattttgagtgcattaaatttatagatactgttagagaagtttgaaatattattcattaactctttcaaaccatgaactagatatatcttctcatttattagaaataggtcttcctactatcttttaataaacaagcatttttataggtatcacatatcatgtttttaaatacgaccatattttcaattctattaaaaatgaagtattaaaaaatatatatttgttgacttatagaatacattttttatattgacatattttcactagcctttctaagccttattattactttacaaattgtctatagattcctttggattttctacacagacaattatataatattcaaagaaagtttgttttctttctaatctttcacacttttatctatttcctcaaaatttcaaatgtatcagttataattgattatgttggttgattgcaatgatgtcttcatatataattatttatttttactttctagtattatttgtgctttcagcaaacatttgttaatctgttagtcttttcacagagccagttcgtatgcctggatcaattgattcctgttatatcgttttcctctttttgtttctttttcacatttcttaaattgcatacataattattgccatctcttcttttataatatacattttataatacacatttgatgctataaattttcctctattgttttagccacatcacgttttcatatttagaattacagtcaattgtaaatattacttagctcaaatactttctaattttcattataatctttaagttttgtgaattatttagaggtatgttatctttctgttataaaatttaacccaatgtcattggtctagagatagaaatcaattgacaattggcaaactttgtttatgaaatgccttttgccaagtttcttaaatgattcatgagttattaaaaagaatgtatattatgcaactgttaggcgccatgttcacttgatcagctaattatgttgtttaagtattctgcgtactgtctccttactttctctctttatcttgctctcactctcatttgcttaatgaaatactaaaaagaaaacccttatccctttactgcagaaaatttggaaaatgaaatcagtaaaaaacattacttgtaatctcatcatccagtaaaattttaatgttatttttctaattaatcaattgtacctcttttgaaatatgttacatagagatttcagatataaatagatacagatagaggtggagattatagaagaaaagaaatatttttcccccatcttaggttcatggctgagacccctgtagcaaaagacagattactaagagaaacacatacaaatgtatttgatgtaagttttttatgacacggagctttcataaatggaaattgaaatatacaggtaaatctgtacattgttatgcttaggtttgaagaagagtgagtagttgtagagaaatatgattggaggacaactgtttggggaacttagcaaggcctatttgttcatgtgcttctctgtgtccttgtgtcttcagagataaggatgctcttttcttccaggtatagaagggcacattttgaatgaaagtcatacaacctgctttggagaagggcaggagaaggtccgagtaatcttcctgcttctgctgttttctcaaatgccaaggtgccatattttggggtagtgtgtcctgaaccccagagatggagatataccctggtatcccctccttgaaaatctgctaccacatcttcggggtttatttagccaaaagaagtcaggactgactgtctctaaactttagtgtcttgtcagtctactattggcaaagtttctaaaacagctatgtgttgtcactaatgaagaccagttctgtgtagtttcatacatttttttctgccctgatgatgcctggataatgatggaaagtggagccacagattttggaaaaccgcaagcatgactacaagtagaagcccattgaatatcaacaggaaaagtagttgcagtcataatccctttcttagtttggacccttttccccaaagaaatgtcccttctttttccatagggaccaactttgcacatgctgtaagagggagtcctgttaaaactccctcccccagcaatgggttgcctacttgtagattacatttgaatagctaagaagagaactcttcaacaattgctgccactcacagcctaaagtatattttcaaaagggaacattttattaacttgctaataaaagaaagagttttctttgttatttcaattggaagacagcttttctatcaaattctcatagtcttgtaataaaatagttttcgattgtctaccacgtcttaagaatcaggttgctaataaaatttagaaagataaagtattaattagtaaattgcctggattttagagaaatttaatggactatgttgattcctctttgtaaatttgtgataaacctagttaggtgtgatagttttgttttgcataggaattaatggttcagccaacacttccctgatgttcagaatagtttaaatagcataaatcaatatacagtacatgtaaaacgttggaggtcagaaactgatacctcaaaatgtagcgctttgacatgttgaactgaagtagaagcctcaggtctctctgaattcctgccaccttcccaactctcaatcctctgtctctcccaaagcagaggatggagtgttctctgaagtttcctcatttgcccaaggcttagatccacccaagaagaaagcagttaccactggtttctcccctgaggtccattaactcccatatcacaggaaaaaggactgaagtctgtcaacacagctggacagatttttgtcacaaaccattgtctggtttctaggccaaactgaccgtgccctaggccattgtatgttctccaagtccattgattttcctctgaaaatcactagccctcaaatttccatgttcctcctgtctcccctctcataaaaagaagggcatatacacatctgtatcccattgggctattgagtaatcattgtcctaagaatctccatgctgtgcatgttaataaatttgtatggcttttctgttattagcctgccttctatgagttgatttttcagcaaatcttcaaagggcaaagaggaacttttccattgtctcctacagaagcatttaaaattctgtaaaacaatgacaaaatcaaaagccatgtaaaatcgtgtgtgtttgtggtatttttagcaaaattttatttcatatttatataatccaaaattctaatataatagttctaaatcgaattttagggtccatgaactcatcctttgcacttttgaagcagaggaggactgtgacagagttagaatctcagtttctcagttccacaggctgctactcttcacatggcagctggataatgttcgattttcagtcctgtgtatttataacacatttcaacctgcagaatgcttgaaattatctgctagtcactcttctatcttgaccaacatacaaaatcattgatgtagaattcagtgttgcaaaattttgaaaaaaatagttttggtaataattttaaatatcattggcattagagtctgacagaccaaaattaactccttgtgttataattcattagcttaaaggcatgatgattgtgacaacctcactgagtcttgacttctccatttaaagataataacatgaacctaggttgcaagttcttcatgaagattaagtgacattttatatataatatgcagaaaataggtttgatatgttgtaagcatttgataaataacatttattataataattttcagcaacaataagaaagaaagtcaaggtgttcctaagagacttagaggtttaggtcctacattgcaaaaggtttagtatctgcactgttccaacagaaggagcagacatatagaactcagttcccatccttggtttatttattttgagtattcgacagaagaaaggagtcaatgaaatgagaagacctgtgcgggcaaactaaccttatgtagaatgtgtcctcttattataaaatgagaagacaaccccttttcacaactactacaaaacaatgccatacccatccattgttattaccagttatttccaactctcccctgctatttccagagtccaccttcctgtggggaaaagctaacctagaataactgtatttcctacacctgagaggccacacaagtattacattttacaaggagtaatatttttttttgcaatttctccccaatgtactttatatccatctagtccatagcagaaatagtaaaatttcaaaattcaataaaccaaaataaaaaggtctaaaagctggagccctatatagacagaattataaacgcacattattacaccattaagaaattgttttataacatttaacattattgtaacatgcctgtgttgcacaaattcatatatactatgaataaagtcacatacattaaaacatagagtatgttaaatatggtattcagttttgtaaaaccaaatttgtctgatgtgatgtttttctggaaaacacaataagaaagctttccgagtataaatgacaatgggtttttacacatatgtctagctctcaatgtgtaaatgacaatgggtttttacattcatgtctccaaactggattctgcaaattgtattctaaatgaaaaatatcgctctagtaaacaaatctcataagacagcaatttatctcaaataaatttttggccaaatgtttagtctgtaggagagaaaaagcaatatattttcctcacccatcacagagttcatagctgaaacccttgtaacaaaatacaaattaataagagaaaacatacaactttgtttaatataagttttacatgacatgggaaccttcagaaatgaagacctgaaaacccagggacaactgtgtgtttttatggacaatcgtgcagaagtgtgattggaggacaaacgggtatggtctaatggcactaaactggggggaacttatgaaggcctgtttgttcggattcttgctagagtccctgtgtgacagtccttccctctggctaaacagcaagacacttgtctcatgagggttttcaggagagaagaagcagggagaggtcacagtgaccttcctacctctgctgtttctctcaagtactagagtccatatttggggatattttgaaactcaataagtctttgctgaaatacagtgtatctatattcttttatctttaacttttgtatattacacaccattctacttttcttttttttaatttttttttttgagatggagtctcgctctgtcacccaggctggagtacagtggcgtggcgagatctcagctcactgcaagctctgcctcctgggttcatgccattctccagcctcagcctcccgagtacctgggactacaggtgcccgccaccacacccagccaattttttgtatttttttagtagagacggggtttcactgtgttagccaggatggtctcgatctcctgaccttgtgatctgtccgcctcggcctcccaaagtgttgggattataggcgtgagccatctacttttcaaataaagtgatatatttgctaaaattgtgtgtaaactaattatagcaaaatttttataaataaaattatttcaaagataaatcttacatcctacagttacacataaagagtagtgttgtatcagatctacagtgtctaacagcctttctctctgttaatgttacaaaacattgatcattggtagcccatgctactgtcattttaatacaagcccataaacttgaattttaaatgaatcacccaaatgatttttcaggtagtcatcttccagaaagattggcttgtagaattgaaattttattctacgttttctaactatcaatagttaaaatctacatctcaaaagtgagctgtcgagtcaatgaagcccgggagtttgcaggtttggctttgaggctccatgtgtttcaccgtgaataagtgtagactcacacattcaagaagcatgttccaccctgtatatgaataatagtcttcaacctgccaggcttgcggcttgataggcattatagcacactgtatattgaagacgtttattttatgtcactagaacaattactccagcgaaaatttagtttgttatgtactttgtataaaactcatgtcttctcacatgaattactgggaagccatactttttaaaaagttgtaatagaattaaagaaagttaactcctagaataatagcagaattggcaattgatattccatctagaaatggctttcaaatcttgagatgactcttaaattcaaaagtttgagagttgagaagacacattataggactttataataacagaaaaaattagctgtaggggttgtagggtagactcaggtttgtgcactgcattccatccatgttatcacaattagagacatcatctaaaaattgagtgagttggttctttttccaagagtcagtacaaactgaaattctaaagagaattttttaaaagttaaacaacttatggatgacaagtttaaaatgaaatattcaggaaaattagggcattaattaattcattcatccattcatagtatttatttggtaactattaggttctggaaaatgtgctaaaatatattaagaaataaaactttaaaagtccatactttcatgaaatttgagattatttggggactagagacaagaaatgttatcaaaaatgatgttagtggtatgataaaaagggcacagaattctatgaaagtaaatattagaagataattcaaatagaagtttcaggaaattattttgggggtacaaaataattaatagataacaaccttaagtactgaggggaactggttagataaaggagaagatgaaaagaaaagtgtttctcagggaaaagctgtatgtgagaggaggctgtgatcagataatggaaagaagctttgcaggtcaggggcaaggttcaaggtgagagagttggcagaaaggagggaatgcatcaggcgggtagcttaaagcatgccaaggattgcaaaatttagagcaatgggaaaccaccaagatttttatgctgacataattatacttgcatttttgaaatatcaatctagttgtagaattgagtctggaatgtagagtgagaactggcatgctgtgacagaggtcagacctgagagagtgggccagagaccaggaaaggtgcatgatttcaatagggagaatatgtagatatttgtgagtcatcagatgaggtgagtgaagaagatggaaatgtaaccaatggcaattaggtttcatacataagtgaatgaatactattactttttcctaaacgagaaaacactgaagagagaacctaatggagatcaatatagattcagttttggacatgttcatattttctatgagatacataaataaatctcacccatgggccacaatgggattgacataagatgtcagcaaatatataaggaaagacatgagatgcatagaaaacaaaccacaaaatagtagacacatattctaccttatcagtaattatattaatgtacatgaattgaacactgcaatttaaaggcagacactagcagataaatttttacaaatgatacaactgtatgctatctaaaagagacacactttggattcagagataggaagtaaaaggatagaaaaagacaagcaaacggtagccaaaataaacctgaagtgattatattaaagtcagacaaaatagtccagaaggtaaaatttgtagctaaagataatgaagagaatttcatgatgataaaagagtcaatccatcaggaagacataacaattataaacacatatacaagttccaaaatacatgaatcaaaacctgacagaattgaagggaaaatgtacatttcaacagccgggtttttaatatccatttcagcaatgagtatggtgattagggagaagatcaaaaagaaatagaagatgttaacaacatggtcaactaactagacctaacagacattgatggagcactttgctcaacatgagcaaaataccgattcttctcaaggaagttcaacgcacattctccaggacaggccatctgttggactgtaaaacaagcttcaataactctaaagagactgaaataacacagaatattataggtgctaaaggatgtgatgccttgcctcacccatcacaagggtcacggccaatacttctataataaaagatgagttaacaggagacaagcatgacaactttgtttaatctaagctttacatgataggagccttcaaaaataaagacctaaagacccaggggaagctatttttatgcttcctttcgatgaagaatggaccattgtgtagagatgtgattggaaaaaaaggataagatctaatgctaatagactgaggggagaaatccagcaaggcctttctggagtgaaagcataaagaaaacaaacattgaacatggattttgatccagtggcatttgatccagtgcatttttgagaagcaatcttgacagtggctaggaacaggagctgaatccctgtgcttcaattgccttatctgttaaatggggataatagtagccaccttatatggatgtcctaagaattaattgatgtaaagatttataatagtctctcggcaaacaatacaaatttaataaattgcagccaacatagttataatcatatcgattcttcagagtaaccacccagtctttgcattctcatccacacgttgccagaggagagcacaaaagcatacaaagactcgcctgaagccttgcagccacaccacacagcaccgagacctcatcaatccccctcactttctgctaaatcacctgccccacacgtgattaatgtgccccgacctctcatgtctcattttgtagtcctgatttatgtctttctgttgtgttgtgagtaatatgtttacagagggggagaaaattataatattgaagaaagggaaacaaaagtgaggcagtcaggtatgtgaaagttatagtaagatttttatgtcaatgcagctcaacatttctgctatattctgttttgtaggcagaacaaaatctctcttagttagaggctgaaatccaagggacttcgatttattccaattttcaagtagaagattttattttactcaggtaaacatagactgtgctgttacataaataaataaataaataaataaataaataaagcaagcagaaggtgcggcatagatttaaaaaactatacttggggaaaataaaattaaataaaatcatcgtcaaaagttcttgtgcactttgaaattcagattgcatcgtgagcttggattgccaatatccttcacgctgttgcttgccagactgatagctctttccattcattacagatagaaagtgactatgaagctttacaaagttacgggcaggtgcaaagctgttgatcccagcctagaagatacattttatatgcctgtgaagattgttcaaaaaaccccaactgtaacaccaagttgttagaatagtttaagaaagattaagccagagaagggagcttcattttttgtgctgacaacacttacggggttttagttgaacccagccaagaggataaattgcaaagtaattaagaggaagtctaaatccagatttgttcagtttgtttcttaggatcgttaatattaactgactttcacattcagattcacttaacttggcaaatgccatgaaaacgaaatcacataagattttgcagcctaacattctttccgaaatgggaaaagctactcagcctaagaaatatttcatttgattttgaggtgtttcacagactatgaaaaatttaatttcacaaacaagtgccaaacattttgtttgtctttgaaaaataatcatttcaagaagaaatcaatgactttcagaaataaaaccagtagccataacaactcctccaggcattttccctgaaatgagtgggtagtgactattttaaaggacattttcattgactttgctgtattatctgacactttaagaaatgtcagagggtattgtttcagggactcttatttaaattcaggttaacgttatacgcctgcttctcaggctccatccagcttcctttgtgactcagttcaataacaaataatgatgaaccattgaaccacagacatggataaagacaatcccatgtttccattacagacccaattcaatggtttcccatgttctttaattgtatggattagaatgcacagaaaaatggtatattagacattagagatttcctctcactttccccacaaaattttgacatgattctcccagaaaaaaatgcaaagtagaaatggagattcccgtgattgacagtgatgttggagcaaagcacatttccagcatctgcttgcgtgaccctggtaaagcatgggcatgtgcggttcaggctcagagaggcgtggagtttagaaaaaacagcttaatagcaaaacattcactctttgtttcatggatggaaagattaaaacgtatcaattacattgttcacaacaatttaaaaaatccagctttcttttccaagcatttctctcacatcatcagttatagtcccagactgcgaagtctagggttattcaggtcaaattatctaacatttgcaggtgccaatgatgagctagccattttgcatgataagtaatctgcaccccaattatcataacatcctcccttcttacagatggcttagccaaggaggagaaatgtaacttgcgcagattcacatagctgaatctatgtgaaatcaaaatgtttgatttcaaaacttacactttaatatcacactatgctgactctcattattcttaaagctgaattttgtaattgaggaagagttgatttcaaaatgtctcaaatcctcagctcaaattcatgggcagttttcattcacttctacacagcatacatgtgtaatatatgttatatataatatagattttattatgtaaatatagtttaaattatacatttttaaaataaaaatatgaattttctttttcattatttcaaggttttacatgtgcttagttttaaaaatgagttagcttcttttatctttaacttttgtttgttttccaaatgtctagttgagtcattccatttgagatggtaatttttaactttccttgcttacttctagagtaacaaacctttatccttaaacctctggatttggcattatttttccatctatactgaatctttattgtataggagccaggataaaaataagaataagaggaaaatattgaacagcagaatgagaaatgtatgtttgatgccatcaattcttcaaatttttcaatattattttagagagaaacatggaattatttgctgtaaaatgttaccctaaaacaacaatagaaagtgaaaaatctaaatatcacaattttcaactgctgaaataaaagaaaatatttaaaaaattgagtcaaatgtttaaaacaaattagtttttgaatggtcttaaattttaggaaagataaataattcattaaagttcaaagaatttactttctccattaccttaggtctatgcaacatattagtttacttttgaatgaggaaataattcacaaaaggttgatctttacttttagaagaaataatttaatatactataagaatgatcaaaagtttttattatgaatgaaaggcaaaatgcttgtgtaaacatttatatcttataagtaagttttctgttagtatgctgtgttctgacatcaatttgctgacactaactgggtgtcccgtaatccagtttaattctgacagttattgcctggagttagcacagacccacatattaagagcaaagtcgttcacaggactgtttccacttcagacaccagccacagctttgggtatccctaagctaccacacttctgcccagccagctacaaattcagggcttcccacaatctctttagattgaataatttgctagaatggctcacagtattcaggaaagtgctacttagaattatcatttcattataaaatttgctcaaatggctcacagtactcaggaaagtgctgcttagaattatcatttcattataaagaatatacataaactgccacatgaagaagtaatagggcaagctctaggagagtcctgagcccaggagctttcgtccctgggaagtcgtggcatgccagcatcctggttcacttacaggttcaccagtcaggaaggtcctttgagcctcaatggcccgagcttttattgaggtttcatcacctaggatgattgagtaaatcactggtcaggtgattaaattcaaccttcagcacccatgctttccccagaggtcaggctggtccagagttccaattctcgaaacacaagtttggcctttctgggtatcaatcccaatcctgaagccacctaggcaccctccatccccaccaggagctgcctcattaacataacagaaattttcccatcacgctggaaattccaagggtttttgcagctctgtaccagaaacatgggaccatgggatgaagaccagatctattttatattgtattatagatgtcctctgtgtgtttatctaggctcataattgatatggagctttaaatagttttttctgtcatatacatttcgatgttcttccactttgttgttttaaaattactttccaagatagtgaattccttgcataaggttcatattttctaaatgcacacaaattcttttgcactggtagcttaaaattgtttagtaatggtaaagatggtttgagactgagataatcacccagagaaagatatattttttccttaaaaattaggcaaagctacatagcattaagatcttttactagcagagtacattttcagatgcccctacattacataaattagtgcaagaccaatccagaaaaaaagaagtagccgatagaattatagtgtggaagtcaggcagtctttactttatactgacgtatcttttaacaattaagactaagagaaagaatgtttttcaatttgtgtatcacctcttagaaagctgaacaagtctgatatgacataggctagctaggccaattagggataaattagagaagaacacagacccaatacaggtggttcagactaatccattcgtctttcattcgtttaaacatttttattgagtgcctgtcattctagaatgacagcagttacaattctaggcatcaagagtgtagtccttaagatagaaacaaattccctgacgttggccaggtgcggtggctcacgcctgtaatcccagcactttgggaggctgaggcaggcggatcatgaggtcaggagatcgagaccatcctgggtaacacagtgaaaccccgtctctactaaaaaacacaaaaaattagccgggcgtggtggtgggcatctgtagtcccagctactcgggagcctgaggcaggagaatggcgtgaacccgggaggcggagcttgcagtgagccgggatcgcgcccctgcactacagtctaggtgacagagtgacactccctctcaaaaaaaaaaaaaaaaaaaaaaattccctgaccttatgaaatctacattcttctctaggagtcagagagaagcaaagaatgtgaaatacaatgtcaggtagtaataaatgttatgaagaaaagtaaagaaaataaagggataaagaatgatagagtgagatggtaatttagaaagggtggctaatgaggacttgtctgaatgggtaacgtttgccagagacctgaatgagatgaaagaataaaccatacaaatatctaacagaaaaacatccgaggcgaaagaacagcaagtgccaagttcttacggaggaaatgaggttggaacgtttaagggataacaaacctgtgactaaaatatggcaagtacagtagagaacaatacaagatgtggtttgagaaatggctgggtaccagttgatagaaggtctgtatagaccaaaataaacctgaaaaaaggaaaagaaaattagaaaagaacaaaggccttgattataattacctaaaattgattcattttaacatcaatttcacacaattttaataagtagtatgttccaaagaaagaaatacgtatggtcaaacagatttagaaaatgctgggttaaaaccattaagccttttttttttttattgtaaagattttttagaacatttcatcatttgatttgtgttcaatctaatacagagattgtaatcagaatttttcaaatttattgtcctgaataactttttcttctagtagattatctcccaggattagggttccactgaattcctttaggaatcattattagttgtcaaacactgtaaaaagatctgagtggcaagaggtgtgtatttaacaccaaaactagaaatgtagtttagattttatgttatttatcacttgccaagagaacatacagagagaaaagcattgaaaaaaaaaatagattacatggagtgaagttttataaggagatacagcctttagaggaactaactttccaagttaaaaaaaaaaaggtatttagttcttaaaatattccttctgccttgttttcctttctccttttttttttttttttttttttttttgagatggagtcttactctgttgcccacgctggagtgcactggcatgctctcggctcactgctccacaggttcaagcaattcttctgcctcagtctcccgaacagctgggattacaggcccgcaccaccatgcttggctaattttgttgtatttttagtagagacaaggtttcaccatattggccaggctggccttgaattcctgacctcaggtgatccacctgcctcagcctcccaaagtgctaggattacaggcgtgagccactgtgcctggctcccttctccttctgagcttttgattatacatatgttagactgtgttgtctcacagatcatgggtactctgtttttgtttgcttgtttgtttgtttccatgttttctatttgcatttcattttgggtaatttttacagacttttcaactttactaattctttcttcagctgtttggagtctactaataatcacttcagggcaatcttcatctctattaggtttttcttttctagtatttccatccaattgttttttaaatcttcatccctctgctgaaatgacctttctggtcttgcatgctgtctgctttttccattacagcctttaacatgttaatcaaggttaataaatttccaaggtttgtgcatagctaagcctgcttggctccctgggagagtgttgttttcttcttgttattttgtgtgtgtcttaagttttgtggggaaagttgggcatcttctttaaaactgtaaacatgaagttttttttcctgcttagaaatgagcatgcctttccttcttgtaggtctttagtgtggagagttgaattattaatctaattaggagttgaactgggcttaggtttgctgtgctacggtcacctctaggtaccacaggtttaaacttcctctggagatatattgggtttagggttgtggctgctttgccaggggccaggggattttttttatgtctcttccttttgcttttggtcttccctgtgacctatgcacctatgcctcagagagggtctttttcttttcttttctttttctttctttctttttttttttttttttttttgagacagggtttcactttgtgctctgtggcccaggcttcagtgtgcagtggcatgatctcaacttctgcctcccaggttcaaatgatcttcccacctcagcatcctgagtagctgggaccataggcacatgccaccatgctcagctaatttttaattttttttttttagagatgaggtctcactatgctgccaaggctggtctcaaactcctgggctcaagtgggcttcctcccttggcttcccaaagcactggcattacaggcatgagccactgggcctggcttgtctccttcttgtaagttacatattgctagagacttgctcattggcagtgtgcatgtgtggatgggtgtaacttctgttgttctggataggcctcagtcctaggcaggcagtgaacccctgggtgtcggtggggggtagccttctcagtgccctacttttcctctagctgctgtaggcctgggttccatgtgaatcctgcaccaccactccccatttcaccacatatacacagataaaaactttggtttcacaagagacatgggggaaggatcctggtgaaattccttgcttctcctacagtggttaaagttttctttccccagtctatactacaaaacaaactttctcaagattctttaattttcatctgattcaggtagaaaaattctgcaagaggatatggacttcccctatatacgtggcccttagtgctttactctgcctcagcaaggcacactcagtccccatcaatcaaccagtcacctgtgctgagctcttcgcactggtctcaatctgcccaggtaaaacagtgctggcatttcatctccccctggaggctcctctctcctcagatttcaggaccgttggttgtcctgctcagctttctggtgggttccagaaaagttgttaactcaccgtttatttggggttttgctgttgttgtaaggctagaagtgacactcatttcttctgtcttcgtggaaaacactcaacaggtaagaaaaaaagaagcaacatcaacaagcttactgaggctatcactagtttagtcacggtagcaaaacaatagatttcttatataattatcacatctgaaagtgataatataatcactattgcaaagatcaggaataaagtcattttcttatggagtcagcagattataggaatggtggctcaagcctccattgagcttgtggactagaacgacagtgaccactctttggttgtttgcttatcgtagggagcacaacaggcttccctgtgctggctgcggacatgacgacgcgctgggaacgacagcagtgggaggtgtcatgtttgcttttacacacttcttgcctctataaaagcctgaacttaaaatttaatttttttagtaaatagctctcagtgtattacaaagtgtacattcagttatccacaactaattatttctttctgtttctaatgtgccaagaactagtgcatgctaaatataagggaagatacctgattcctcaccaaaaatcttggtacataaaattgggaagaaagtaagcagcatcaatctgtttataaaatctctttgtctcagctttttcacctgtgagatagaccatcccatattattcattaatgatatttttttgtgaccagcagacttctcagtggtcagatacatgtacctcgatccttaaaggtagcaaccatcactcatagtgaccagatttgcagaggcagcctctcccttctgtcccacagaagtctacagggtatcctggggtcctcattgcccgcctctatgaaaatcccacgtcctaaatggattgtgtgtaatttctttctcatccagacccattcttccttcctggtgccttccctgccccatcttctctttcgtccctggcccagatctctaccttgtctgacgggccgtggcccttgcttcctctactacattgtgacacttgattatatcttgtcttatatctttctccaaagatttcatggatcatgtctttccaaaattactagactccctaaggggtgaagcatgtcagtcttattttgcatcctcacgctcccttgcacactgtcagacacagagcaggcatgtgacaaatgctaggttgcaacaagtctgagtttcttaatggaagaaatttagagagagaaagcgggggtgctttggtgagagatatcaactcattgagtataatgaggaaggaaccggccaaccgccgtcaattaagaagtggagcaaatgggctaaaatcgctgtaacgtgctccacctgagctttctgccgtccagggccgctctgtttcactggggtggaggctgccactgctggcagctgaagctgagcgccagggtctcttcctctcctcctcgtcctttcggatcccgggccctgcggccgcgcttccgcttcagaccccgcatcaggacccgggacacggggacttcttccgggctgcaggcgctgggcaggcgcggcgcccccgcgtggttccttcgcaggggacagcaggtttcccgccccgccgcgtgggggcgcgcgatctgccgtctgagttcaatgcgactccggaaggacgcaagggagccgcgcaggtggccagctccttaggcgtgtccgtcccagagcaccctggctttatctggtttattgctcatggttcaatcgggaaattaggcagcgtgtccccatgacagcagacgcgggtgacggctcttgcctccctccccagtgcgcacccccgctggagcgcaggagcttcctgcaggttcgcgccagctcgggcctgacactcagggcaaagcggctccaaactgcccactgagcggtccgcacacacagtccttgccctgcaggcttttcctggacgactgctgaagttctagtcgattccacagccaaaaacatggaacaccttgagcaaaaaccattatccaacattagccgttttgtttttttttttttttttttggtcaatgaacttttgttacatgaagaacagaacaaagctggatctaccatatacctggtttgaatttactggccagaacattagcaattaggttttgaccaataatatcaagtcttttcagaatatctctggggaagaaaaaactaaaacaaaatgacagcaaacaaacttcccatagcggccagattctaagtctagtgcttttaattgaaagaggagaaatttggccaactaaaactacatcatattcgtatgcgatgaaaagaagaaaataaacatttctggtcagaaatgtagatatgattaattttaaatggaatcttaattaaaatatgacaacttgaattttcaaaaaaatgtccttggccgggcgtggtggctcacacctgtaatcccagcactttgggaggccgaggtgggcggatcacctgaggtcaggagttggagaccagccggaccaacaaggagaaagaaaccccgtctctactaaaaagacaaaattagccgggcatagtggtgcatgcctataatcccaactactcgggaggctgaggcaagagaattgcttgaacccgggaggctgccgtgagccaggatcgcaccattgcactccagggtgggcaacaagagcaaaactccgtctaaaaaaaaaaaagtccttttgttatgctattttaaataaaactttaaacacttattaaaagtatggtatacatttaaagatagcttttcctcgaagaaaatgtcagcaaggaaaatccttgaattctgtaacatatggtgtttttgagtagctatattcatcatataaaagcaatttatattttcattaaagaaattcaaattttacttatttgacactaatacctacacacaggaaatttcaaacccaagaaataataaattatcgttattctagaaaacctggtaccaccttgctctaccacagccattgctgtggttttcatctttagatgtcttgggtgctgagagctggccctgcatcccaggcacattcagattctctggcaatcaacttttgtgggagaagggaagaaaatacgatggggtagagagagaagttggacactgacgcaatcaacatcaagcctcagccaacccccaaggcagtctgaaactggacaggctcttcacagttgcccagggaggccaaacagagagagtctttataccctggcaaatgctagtcatggggagacagatgccagagggagggggcctggacttcagcaagtggctttcttcagcctgaggtaattcgccaaacgtctggggaactgcagctgacagctgcgtgtctctcccagcagtcagggagtcagtctttcaacctgcaatcggagcatgcagccatttggggactttcagtttgcagagtaaggagagctttggtctggggcggaaactttgcttttctttttgttgtttttctgcttttttttctactggggagaactgtattcttaggctctgcttcttccgtgggtcccactgtcttcaggagaggccttcttggacaagcagcctcctttccttagagagcaggtcatgggatttccaaggtcacaagtaatgtctaccagacattccgtttacatacagagaagggagacaactgtctcaaaaagtctctttattaaatcatcccctggtcatcctatgtcatagccctatatttttccttttatggatttactccagagtgggaggaaacccacatttttctctgctgtcttgggctatggcttcaccttttgtttaaaaatcaatctcatctcatctgctattttccaagaacttttcaagaatctagtctattcataacaccctttctggtttttctgtgctgtgatgactttccttcttaaacctacatttattttattccattttgctcttgagcaggaagtctgtgtattaagttctggccttgattgcaaatgccaagtcagctcagtagaatggaatgggtatgggttgtggcttcaggcagacacttcactcgggtctaccacttactatgcaacttagggtcaatcacataccttttgtgagacccagggtctttttaaagtgggaatagctggtgcggtggctcatagctgtaatcccagtactttgggaggctgaggtgggcagattacttgaggtcaggagttcaagaccagcctggccaacatgctgaaaccccatctctactaaaaatacaaaaattagccgggcatggcggcgggcacctgtaatcccagctactcgggaggctagggcaggagaatggcttgaacccgggaggtggaggttgcagtgagctgagatcacgccactgcactccagactgggcaataaggcgagactcagtctcaaaaataaataaataataaaataaagttggaataatagtatgtactgcataaattagacataaggatataaaagtgcttagcataatgtttggtatagaacctgcacacaagcaatggttgtcctctcctttctttgtatttgtatccctcataacattttttgttttttgttttttgttttgttttgttttttgaaatggagtcttgctcttgtcgccgaggctggagtgcgatagacgatctctgctcactgcaacctctgcctcctgggttcaagccattctcctgccttagcctcctcagtaggtgggattacaggctcccgccacaacgcctggctaatttttgtatttttagtagagatggggtttcaccgtgttggccaggctggtcccaaactcctgatcttgtgatccacccgtctcggcctcccaaagtgctgggattgcaggtgtgagccaccatgcccggcctgtatccctcataacattaatgtgccttgtgttctcatgaaaaagaaaaactttaatacaatccaaaatccatcagaaaacgagacaaacaaccttaaagattcagcgaggcttggtttgtttctaaagtgatcgcttaggcaatagtgcctataatatcgtcaccaccaagtactgccttgaggtgtcacagaatgtcatacgtgacagtgatagcattctacattacaccctcttgcttaacatatttgtttttaacaatttttttatttctttgtaaacttgactggttaaaataaactagtattacctagaagtaggaggtcaatcaaagactaatctacagatatatgaaattcagctggagtcatttatatgtaatagttgtatgacatctgagaaatatcacaggactaggccttctacttgccagatctgtgactttgctttgagcctgtcactttgacctttagcctcagggtcccagcagaaaaccttcttaatatgtctcctgtgttagtttcttaggactgctgtaacaaaagttccacaaacttggtggttgaaacaagagaaatgttttctttcacagttcgggcagatagatgttcagagtcaaggtgtcagcagggttggttcctcctggagactctgacggagaatctattccatgtctctctctgttccctggaaagactgtatatggaaagtggtctgcaaatgccaaagcagctgagaaaccaaagaacgaggcagacaaatccagcttgtcagtagagggtgatttattggagaatttatagacagaagcgcaatcttgggtggcagcaagacaggcagataggcagatctctgcacctgttacccccagacccagggctcatagggaaaaggtgtacatcgtctgtatgaataactaagggcagctctccagaaggggcaagaatgccaggtacatcacagcctatgatttgcgcaataatgtcaaggttgacatttacacaagggacagtacgtaaagtaggaatcaggaggcattcacaagactggggttgatcagaagtcaccgtggcagattgacatcaaggtgaggtcacttttgctccccactctcctagtttctggcaatgtccagccgtccttggcgttcccggctttcggtgcattgctcccatctccacctctgtcaccattccactgtctttcctctgggagtctctttccatgtttttacctggcattctcctatgtgtctgcgtcctaattttcctcatcttattcagacaccagacattaaattagggtccatcctaattcagtccgacctcatcataacttgattacatcatcaaagaccttattcccaaataagaccactttcacaggtcctggggattcggacttcagcatatcttttggagaataaaattcaacatgtaacatttcccaaacatagaacattttacagtggctatggtagttaagatattgtgtgtcatgaatctaaaaccaagtaaccaaagatgaaatattttgagaaggattcttgaaccgcctggaattgagttggaaattatgaacaaaaggaaactgaggacagcaacgttaaagggaattggggaagacctttcttctcattcctgctcatctatgtacctctgctccattcttctctctagctgtaaatcaatgttctctgttttccattttgtgtcacagaacatggctaccgacaacgtcccagggctgaagagaaacgtcaaccaagaagataccaatatgaaccctttttaatagagagagatggagaaggagaaacctcagagacttgccttctgactttatttttccccccaaaagagatgggcttattttctgcaagaaaagaggcttagaaggcatttttaaaaggagccaatattaaagttttgtgaaagtttttctagggaaggagagttattgatggtaggatggtgtggcatgttcggtatagatgatagaagtgagggtgtgttagggcccaggtaaaggcaggacaccatgtgtgtttagtgggctgactttctcctcgtttgcttttcatcagcaatggtcaataactcctgtgtgtcagatggttactagaggaggatgttagacagctgctaggtgagcccagcatctttacatgaacaacccaaggggacactgcaagtttattcaaccttatctgtgttagagtatcttcatggccacacggtaggttgtgagatggacatataaagttttagtaaaatcacttttcagatttccttgtagatatgtctaacccttaacttccaaggaaaagcaacattttaaaaaataagtcaggccttcttagtaaatatgtgttgaattactaattttataaattgaactcacaaagaaataacatttgatttataaatatgggtatgtgtggttatttcatccttggagaaacttcaggagcgaccctttgctctttataaatccactgactcaggcagagtcataggcaacagaaagaagcccacattcttgcctcactagttcattagtttttaagcaagatatttaaaaattacctctagcacactaaaaagtactgtcttgccaaaactttagttttttttcctttctctttttgtttgtttgcaaggggcagtctaaatagaatatcaacttaaagaaggccagggcatggtaaattaatttctttataatcttattttctatttctcctttttcttattttttctttcttcttctcagttgaaatactcttttcaatatttgttaattacctatcctgatatttttaaaccatcatctccctctctccaagctttccttattctcattccccaaataatgtaagtctaaggaagcgtctttctaaaagctttcccacaggtaggtgataaaaagctgaggagattttcttctttcttttcagtgggtgttggtgtgatcagtgacgggagaaagcagcttcccgtgcagtgcagttcttgtaaagggaggagtagaggggtggtgtctgtttgatgaatagctttcattgttttttatttattttccccaaagcagtgttctccgggcagaatacttgattgtaaaagcaggagacttgtattcaccttctcgttttacattgattttctgttctgcttgaagcctttgtgtttataaatgtaaaaagaaaaaattaggaaaatctgcctgtatttcacatggtgattttgggcctgcctcttgactggggcaccagttgcctttttcataggaaagtgtagaggtgtagacttcacatccaccgtatgcactaagcttccctagaggtcatctgcctgtgggtattaaatggggctgtaatcatggtctctgctggactttattcccctgtgctcatagttttcagagtgttggtgagtgattcaagcaagtacagccaactgtgttaccagctatcacacgatgccctatttttctaccagctatcacacgatgccccatatttccttttttctcccctttctgccatccatcgggcaccagaaccctctgtcccctgattcagctatgactctccgaagcttcagggcgttgtcatgttaggggagggtggggacggacctgcatttctctcacattcagtcacatcccattagacctctgtatagaccccatgctgtactcaggatctctatcatcccattagacctctgtatagaccccatgctgtactcaggacctctccacattttcacttgcttgaacttgctgtgactctacagttttcatgcccttcgggtgagttatgccctaggatgcctcacagtttcccaaagtgagctttgtccaactgaagtcaaaacagacacctctctaatgactgtagtctgtacaatgtagatactatattcaggaaaaataaacaaaatacaaatttgtctatatatgtgtatgtgtgtgtgtatgtgtaagccccaatatgtggtgttttatagataatgggaatattttctttgaaaatatcaatcttaaagaaagatttaaaagtaagaacaaatagaaatatcttttatgcatattcatctatttttgaagtctgcaactgcaacagtggattcacctattccttgcatttctatccatttttgcctcacatgttttgatgctctgctgttaggctcctgcctgttaagcactgttacatcttcgtggagaaatgacccatttatcgtcacttaatattcttcttctttactcctgataactttccttgttctgaagtctgctctgcctaaagttcacagagttactcctgctttcttttgattagtgctagtatagtgtatctttctccacctacttactttttttttttttgagacggagtttctctctttgttgcccaggctggagtgcagtggcgcgatcttggctcactgcaacctccacctcccgggttcaagtgattctcctgtctcagcctcccgagtagctggaattacatgcacccgccaccacggccagctaatttttctacttttagtaaagatgtggtttcaccatgttggctaggctggtcttgaactcctgaccttagatgatctgcccacttcagcctcccaaagtgctgggattataggcgtgagtcactgcacctggcccatctatttacttttaatctatatgtctttatagttaaagtgagtttcttgtagacaacatatacttgggtcttattttttgatccattctgataatctttgtcttttaatagttacatttagaccattgatgttcaaggtaataacaggtatagttggattaatatcaactgtatttgtaatactttctatttgttgaccttttttttttttttttttgggacagggtttttctttgttccccaggtgagtgcagtggcgcaatcacagctcactacagtctcgacctcctgggctcaagtgatcctcccacctcagcctcccaggtagttgggactacaggcacatgccaccatgcctggccaatttttgtatttttttagagacagggttttgccatgtcgcccaggctggtctcaaacttctgagctcaagtaatccacctgcctcagcctcccaaagtgctgggattagaggtgtgagacaccacacttggcctccctggttctttgtttctatttttgtatttcactctttttctgcctttgtgtatttaattgagcattttataggattcaatttcctctcatttcttagagtttgcaatacacgtttacaaataatataaacccattttgaaacaacacttaccacttcagaatagtatgaatagcttataataacaatcctaaatcctccctcccatttcttgtatcattgctgtcactcatttcacttacatataagcatacatacatatatatacacacataagatagatacataagcatatataataaaatacattattgctgttgttattttgaacaaattgtaatctcaggccaatcaaaaataaggaaaataaagaattttaatttaccttcactcattatttaatcaatgctcttcctttcttgctataaactccagtttctgacttaaattattcatcctctccctaaagattttcttttaacatttcttttcttttgaaaatagaatcatgctttgtcattcaggatggaatgctgtggcataatcaacactcactgcacctcaacctcctgggctcaagcaatcctcccacctcagcctcccaaggagctaggactacaggcacttgctcactacaccttcaacctcctgggctcaaacagtcctcccacctcagcctcccaaggagctaggaccacaggcagttgccactatgcctggctaatttttatttttattctttgtagagacaggtgtcttggatttttggcccaggctggtctcaaattcctggactcaagtgagcctactgccctcagcctcccaaagtgctaggattacagacatgagccatcatcaaccacgttcttttagtatttcttgcaacttacagaattttttttttatctctagcatttctttttgtttttttcttaagattttcatttctctgtttacattgctcacctgtttttgcatgctgtctgctttatgcgttagggcttttagcatattaataataattgctttaaattccctgtttgataatcccaccatttttatcatgcctggttctcatgcttgctctttctcttcaatctgtatttgttttttgttctttgccttttagtatgccttgtaatttttttttttttttttgagagccagacatgtattggataaaagtagctgctgtaattaggccttttgtaatgtagtggtgaaatgttgggagagtgtaaatgttctacagtcctataattaggtctcagtcttttggtgaacctatgcctttggactgtaaccttcacaaatgtttctgatttcccactcttaagtgggggcaggatggctagatgggctatagttgagtatttctctgctctcatgtggaagctaaagttggctgcagttgtgcattttctctttcacaggttagttagactatgttaaaaccctgtcaagttaggctctatttcattcctcttcagggtagacctcattaagcagaatgcagtgccatgcatacttcaaaatggtttcttttcccctccccttgctagaagcattgggggatttttctccaatatttagaatgtgaacctggtcaaccttgagagataagaatacaaaagcatgggggctccctataactggaacttcatggaatttttaactctcagacttgttcacactgatcctccaacaatttatcaattaaagttcagatttccttaccctggcactggttcctgcagagaattttgctccagtatggtgtgattctctgtatatgcctttttgttttcaatctggaggcagcagtttgacctaatttttcttatggctcttggcatacttgttgatttttcactttttttttcaagtttatacttgttagaataaagttgtgacttccaagttcttttcatgaggaactcaagattcatctatttttaacatttttatccatttccattttccatttggctgtcctttctctgtaaatatacccatgcatatttcataagaattgggatattctctgacagaactacattacagttaccaacttcaggaaatgagattaaatcttttaatccaatcgaccatcagtattctaattctgtcaaatgacctatcaatcttttttgttttgttttgtttttgtttttgagacagagtctcactccattgcccaggctggagtgcagtgttgcaatcctggatcgctgcaacctctgcttccctggttcgagggcttctcctgcctcagcctcccaagtagctgggattacaggtgtgcacaactgcacctggctaattttttgttgttgttgtattttcagtagagtcagggtttcaccatgttggccaggctgatctcaaactcctgacctcaaatgatccatccacccctgcctcccaaagcgctgggattacaggcatgagccaccgtgcccggccaaatgacctatcaatcttttttatagtacttttctcttcattacaggatttagtctaaaatcagatgtttagtttttatgtctctttattttcttttaatctagaatatgctagaacacttccacaggattctttgtcttttatgattttggctgcttagaatattcctttgggtttttctggtgttttctcataattagatttaatttatgaattcctgaccatatcacatctggggccacatgacatcctcatgttcctcaatggcaacattactttcgatccgtctgttaagatgtcatccaatttctccactatataattattatattttcccatgctactcataagtggtccaggagaaacactttatgaccatgcaaatatcctatttttcatcaaaatattgctctggatttaatatctttgtgatttgtgcctgaactaatctttattttgatggttataaaatgatgattttctagttctgtttccagtttcgatttctagtttctagaagccggacaggttcttctttcctgctgcacagatagaatcgatttgccaagacagctgatttccaatagagaaagatgttaataaacacagagccagcgaagcagaagaccagaatttattgctcaaaacagtctctctggaaatttggagactaaggtttttaaggataacttgctgggcgggggggtagggaaatgggtaatgctgattggttgggtctaagatgaaatcatggaggctaaagctgtcttctcactgtctttagtttctgggatcacaaaaccagttgagccagtttattggttcaggtgtgcaacagctggtccaatcacatgcagggtctgaaaaataccctgaacaccaatcttaggttttacaatcatgatgttttctataggagcaattgaagaggttacaaatcttgtggtctttggctgaatggctcctgagccacaaccctcaacttgtgccaaatttgttagttttctgaaggaggcttttggtccctgagtcaggatgagattcctttccagaagaagctgttatcatctttgttttaaagttaagctaaatttcctccacaattagcttggcctatggccaagaattaacaaggacagcttggaggttagaaacaagatggagtcagttaggctggatttctttcactgtcataatttttctatgtcatatttcttttactgtcataatttctgcaaatgtggtttcagttttagcactccctacacattttctacttggggtgtaacagtctattgtcagcaaaataaaagctaggtcttaagtcaatgtgaattattggacctgaatttgtgtgcatgccgacacatatacacaccatgcacacacatatgtatatttttaaaaagataaatgcatatatatctgcatatttaatggatgagaagacttttcttctttatatcacttgtgaagagctttgttctcatatgctgatttggaaatctcagaatattttttgatcctagtattcaataatgagtaatcaatcatgaaacctctgttgaagtttatattctaaaatcgtcatttatttttaaaaattcatttgaaaacatttagttgtggctataagttgttagtagaaaaaattagaactgaaactcacttgttaccagaactaaagaaaaaaggcaaaaaggattttatctctgctttgcatccataagggaaatgaacataactaatattcggtggaacttttatgtaaaaatacagctcttgaatttgtgaaagcaaatataagccaacactccttttttttaaaaaaaaaaattggttattacctaatttacgttgtgtctacataaaccaatttaaagtctgattttaacattcagtgtgggccaagagaaggggaagaaaagtaccattaagataaaaaaggggaggggccaagatggtggaatagaaacaggtccagtctacagctcccagtgagaccaatgcagaaggtgggtgatttctgcatttccaactgaggtacccagttcatctcactgggactggttttgggtgcagcccagggagagtgagcagaagcagggtggggcatcatttcacccaggaagtgcacggagccgggggacctccctcccccagcgaggggaagtgatgagggactgtacccaccccgggtacagctttcccagtggattttttgcaatctgcaaaccaggagattctgtcgtgagcctgcaccaccagggccctggatttcaagcacaaaactggacagctgtttgggcaagcactaagctagctgcaggagttttcttcataccccagtggtgcctggaaccccagcaagacagaaccatttactctcctggaaaggaggctgaagccagggagccaagtgttcttgctcagcaggtcccactcccatggagcccagcaagctaagaaccactggcttgaaattctcactgccagcacagcagtctggagtcgacctgggatgatggagcttggtcgggggaggggcatctgccattactgagactttaggaggcgattttcctctgacagtgctaaggagactgggaggtttggattgggcagaattcaccacagtgcagtgaagcagctgcggccagactgcttctccagatttctcctcactgggaaggcatctctgaaggaaatacagcagccccagtcagaggcttacagataaaactctcatcttcctaggacatagcacctggggagaggggcagaggtgggcacagcttcagcagacttaatcttttctgcctgccggctctgaagagagcagctgatcctgacaatggggattctccaagcatagcacaccagctctgctaagggacagactgcctcttcaagtgggttcctggtccccatgcctcctaactgggagacacctcccaaaaggggtcaacagacacctcacagaggagagctccaactggcctcaaaccggtgcccctctgggacaaagcttccagaagaaggagcaggcagcaatctttgctgttcagcagcctccattgttgacacccaggtgaacagggtctggagtagacctccagcaaactccagcagacctgcagaagaggcgactgactgttagaagtaaaaactaacaaacagaaagtaacaacaacaacaacatcaacaaaaaagaacccacacaaaaaccccatccaatggtcattagcctcaaatatcaaaggtagataaatccatgaagatgatgaaaaaccagtgcaaaaacgctgaaaattccaaaagctagaatgcctcttttcctccaaatgatcgcaactgttctccagcaagggtgcaaaactggacagacaatgagattgatgaattgttagcagtaggctttagaaggtgggtaataacaaactcctctgagctaaaggagcatgttctaatccaatgcaaggaagctaagaaccttgataaaaagttacaggaactactaactagagtaatcagttcatagaggaagataaatgacctgatggagctaaaaagcacagcacgagaacttcgtgaagcatacacaagtgtcagcagctgaatcaatcaagcagaagaaaggatattagagattgaagatgaccttgctgaaataaagtgtgcagactagattacagaaaaaagaatgaaaaggaacaaacaaagcctccaagaaatatgggactaggtgaaaagaccaagcctgtgtttgattggattacctgaaagtgatggggagaatggagccaagttgagaaacacacttcaggatattatccaggagaatgtccccagcctaacaagacaggccaacatttgatttcaggaaatacacacaacacgactaagatactctatgagaagatcaacctcaagacacataatcatcagattctccaaggttgaaatgaaggaaaaaattttaagctcagccagagagaaaggttgggtcacttatgaaagaaagcccatcagactaacagtgtatctcgctgaagaaaccctgtaagccagaagagagtgggggccaatattcaacattcttaaaggaaagaattttcaacccagaatttcatatccagccaaactaagtttcataagtgaaggaggaataaattcctttccagacaagcaaatgctgagggattttgtcaacatcaggcctgccttacaagagctcccgaaggaagcactaaatatggaaaggaaaaaccagtaccagacaccacaaaaacacaccaaaatataaagacaatgacactacaaagaaactgcatcaactaatgtgcaaaataaccagctagcatcatgattacaggcccaaattcacacataacaatattagccttaaatgtaaatgggctaaatgccccaattaagacactggcaaattagataaagcgtcaagacccatcggtgtgttgtattctggagacccatctaacgtgaaaagacacacattggctcaaaataaagggatggaggaatatttaccaagcaaatggaaagcaaaaaaaagcaggggttgcaatcctggtctctgataaaacagactttaaaccaacaaagatgaaaaaagacaaagaagggtattacataatggtaaagggatcaattaaagaagaagagctaactatcctaaatacatatgcacccaatacaggggcacccagattcataaaacaagttcttagagatctataaagatatcttcaaatcttagagatcaacaaggagagctaactatcctaaatatatatgcacccaatacaggagcactcagatttataaaacaagttcttagagatctacaaagatacctacaaatcttagagatcaacaagaagagctaactatcctaaatatatatgctcccaaaacaggagcacccagattcataacacaagttcttagagatctataaagagacttacactcccacacaataatagtgggagactttgataccccactgtcaatattagacagatcaacaagacagaaaattaacaaggatactcaggacttagactcagctctggatcaagtgggcctaatagacacctacagaactctgcatcccaaatcaacagaatatacatttttctcagtcccacatggcacttattctaaaattgaccacataattggaagaaaaacactccttggcaaacgcaaatgaatggaaatcataacgaacagcctctcagaccacagtgcaatcaaattagaactcaggattaagaaactcactcaaaaccacacaactacttggaaattgaacaacctgctcctgaatgactaccgtataaataatgaaattaagggagaaaaaataagttctttgaaaccagtgataacaaagagacaacatatcagaatctctgggacacagctaaagcagtgttaagagggaaatttatagcactaaatgcccatatcagaaagctggaaagatctcaagttaacaccctaacatcacaattaaaagaactagagaagcaagagccaacaaatgcaaaagctagcagaagacaagaaataactaagattggagcagaactgaaggagatagagacacgaaaagcccttcaaaaatcagtgaatccaggagctggtttttttggggggaaagaaaaagatagaccaccagccagactaatgaagatgaaaagggagaggaatcaaatagacacaataaaaaaatgataaagaggctatcaccactgatgccacagaaatagaaactaccattagagaatactataaacacctgtacccaaataaattagaaaatctagaagaaatggataaattcctggacacatacatcctcccaagactaaaccgggaagaagtcaaatccctgaagagaccaataatcagttctgaaattgagggagtaaataatagcctaccaaccacaaaaagcccaggacaggacagattcacagccaaattctaccagaggtacaaagaagagctggtaccattccttctgaaactattacaaacaataaaaaaagagggactcctccctaactcattttatgaggccagcatcatcctgttaccaaaatctggcagagacacaacaaggaaagaaaacttcaggccaatatccatgatgaacatcgatgaaaaatcctcaataaaatactggcaaattgaatccagaaacacatcaaaaagcttacccaccaagatcaagtcatcttcatccctgggaggcaaggctggttcaacatatgcaaatcaattaatgtaatacatcacataaacagaaacaatgacaaaaactacatgattatctgaatagatgcacaaaaggccttcaataaaattcaacatcccttcatattaaaagctctcaataaactaagcattgatggaacatatctcaaaataataagagctatttatgacaaatccacagccaatatcatactgaatgtgcaaaagctggaagcattccctttgaaaactggcacaagacaaggatgccctctctcaccactcctattcaacatagtattggaagttctggctagggcagtcagacaagagaaagaaataaaagatattcaaataggaagagaggaagtcaaattgtctctgtttgcagatgacataattgtgtatttagaaaaccccatcgtctcagcccaaaacctccttaagctgataaagaacttcagcaaagtcttaggatacaaaatcgatctgcaaaaataacaagcattcttatacgtcaatcatagacaaacagagagccaagtcatgagtgaattcccattcataattgctacaaagaaaataaaatacctaggaatataacttacaagggacatgaaggacctcttcaaggagaactacagaccactgctcaaggaaataagagaggacacagacaaatggaagaaaaattccatgctcatggaggttaaggatcaatatgatgaaaacggccatactgcccaaagtaatttatagattcaatgctattcccatcaagctaccattgactttcttcacagaattagaaaaactacttgaaatctcatatggaaccaaaaaaagagcccatatagccaagaaaatcttaagcaaaaagaacgaagctggaagcatcatgctacctgacttcaaactatactacaaggctacagtaaccaaaataacatggtactggtaccaaaacagatatatagaccaatggaacagaacaaagacctcagcaataacaccacacatctatctacaaccatctgatcttcaataaacccgacaaaaacaagcaatggggaaaggatttcctatttaataataaatggtgttgggaaaactggctagccatatgcagaaaactgaaaccagaccccttccttacaccttatacaaaaattaactcaagatagattaaagacttacatgtaaaagcataaaaaccctagaagaaaacctaggcaataccattcaggacataggcatgggcaaagtctttatgactaaaacaccaaaagcaatggcaacaaaagccaaaattgacaagtgggatctaattaaactaaagagcttctgtgcagcaaaagaaactagcatcagagtgaaaaggcaacctacagaatgggagaaaatttttgcagtctacccatctgacaaaagtctaatatccagaatctacaaagactgaaacaaatttacaagaaaaaaacaacaccatcaacaagtgggcaaaggatatgaacagacacttctcaaaagaagacacttatgcggccaacaagcatatgaaaaaaagctcaacattactgatcattagagaaatgcaaatcaaaaccacaacgagacaccatctcacaccagtcagaatggcaattattaaaaagtcctgaaacaatagatgctggtgaggctgtggagaaataggaatgcctctacactgttggtgggactgtaaattagttcaaccattatggaagatagtgtggtgattcctcaaggatctagaagcagaaataccatttgacccagcaaccccattactgggaatatacccaaaggattataaatcatcctactataaagacacatgcacacatatgtttactgcagcatcatttacaatagcaaacacttggaaccaacccaaatgcccatcaatgatagactggataaagaaaatgtggcacatatacatcacggaatactatgcagccataaaaaaggatgagctcatgtcctttgcagggacatggatgaagctggaaaccatcattctcagcacactaacacaggaacagaaaaccaaacactgcgtgttctcactcataagtgggactgaacaatgagaacacatggacacagggaggggaacatcacacaccagggcctctcagggactgggggcaaggggagggagagcattaggacaaatacctaaagcacgcggggcttaaaactagatgacgggttgacaggtgcagcaaaccaccatggcacatgcatacctatgtaacaaacctgcacattctgcacatgtatcccagaacttaaagcaaataaataaataaataaataaataaataaataaataaataaaaaatgggggaagaaaaatagaggagagagggaggttatccatctatgcatctgttttttcataacaccaagtacttccatttctatgtgctaaatatatgatatttattaaaaattgaattgccattgtaatgatattaggaggtgggacctttgggaggtgattaggccatggctccaccctcatggatgggactggtagagtctggccccctcttgccttctcttaccctctccttgcccttctactcttctgccatgtgaggaacagtgttccccccctctaaagcatgcagtgtgcaaagtgtcatcttggaatcagaattgccaaatctgctggcaccttggaccttccagcctccagaaccataaataataaatttctattctttataaattgaaaaaatataaaagaagcatttcaactccttggaaatatgctacctccattgtttttggttggtgacatgcagatttgctcttttatcttgtgctttttttctcttctttcagtcattatattaaaaaggaaggcacttagttctacttaactctgttgaatgctctgtccactaacagctgaatgtctcaacaactacacagcattaggatcttggcggctcccgtgtcaacttccagcgctctaaacagtcccctgccctgtgcaatgagcatcatcaaaaagacctaccaagagaagcaaaaacaaagcaaagccttttctctgaatacactaatttaatgtattcatgtgaaagtgcttcatatcatacaattttaaggccaaagagaaagaacgtagcaaaaagttctttaaattttttgtgtgtgtatgaatagttagctaagaatcctagttgaatctctgagagttagcacacaaatgcacagacgctcgtactctgaatatggttgtattttaacaaaagataatcacatatttcttaagtaaaaacatgagttcaatatctgaattcggcacgatggggatgggagaacagaggcaaatgaatgtggttaattatgccagttaccctgaatggatactgcagtcactttcctggcagcagtaggcagcagggaagtgttagagctgctgagtccccgcagcagctggagaagctggaaaagcgagaggtgctaaagatgtttctggactggaagagggcggattccgtactttctaactgcaccctgttttcacactggtgaagacgactctgtcctcagcactcagcagtacactgtgtggtccagaggctgccattcacagttgttgggaagacgtaaaagcatgcagtgaggcctcccaatacagtatcgtgtgttgttctcttaagcctttccacttccaggtaacctactttctctttgcagaggttgctgaagtcaaaagcagctcactcccagttcactgagcttgagttccggctgcaacttggccttgagatttttgaaacgttgatatggaagataaagaaaaacgcagattcctgtcttctaaggaacaaaggctggaagacagttctgcagattctgcctttgagggattagagggatgtgcccaggaccagatcttcagttatgcaaatataccttagagaccacagtaagaaagacatcgctctgaaatgctctggtcccaaggaaaatattgctctatataataatggaaaacgttgtctgtgtatcatgctgagctgcattttattttgtacccttgagagagcttttattttcttataaataaggattggtcttgttctgggtctgaaaactgttgtgtatttttgagatgtctatttttcttttcagttgcctgtaagagattgggagccgagggcctgagggtgaagcctcgtttgtgcaggtgactgtgggactctggtgtaagtaacgctgggcccaccctggtaatgaaggaagacccaggcccaggcaggggcggtgtcacaggcacaggggctcgcaccctgggcactgacggtggctgtcgcaccagggccgctccttgcagaaacctcactgagcctgtgcctgttgagtagcttcatgaggagcggatatcaggcagagaaagcccgggcaagagagtgacacacggggcttctgcccagaacacgtgcgcccacaatcccgggagctgtacaaatcccaagcggggaagcggaggcctcgacagttcatgatgcggacatgaatgggaatgcggccgcttgccacacctccttcttcatttggggaaatgcttgaaggtttgttttgtgaatgctaggttaaggtttggaagtttattttaaaaattgacatcatggccgggcgcggtggctcacgcctgtgatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcgggagaatggcgggaacccgggaggcggagcttgcagggagccaagatggcgccaccgcactccagcctgggcgacagcgagactccgtctcaaaaaaaaaaaaaaagaaaattgacctcaggcagggtgtagtggcgcacgcctgtaatcgcagcactttagaggctaaggagagagcccagaagctcgagaccagcctgggcaacatagtgagacccccatctctaaaaataattttttaaaaattaatcgggcatggcggtagaggcctgtagttccagctacctcagaggctgaggcgggagaatcacttgagactaggaggttgagcctgctgtgagccggatggtgctactgcactccagcctgggtggcagaatggaccctgattaaaaaacaaacaaacaaaaaagatgtatcaacattagccactcagacattgttttaaaatagtttaatcttctatttgagttacaacctgaggtaactcccaatgaaggagataaattatatagaaattaaagaatttaggggaagactctgtaaaaatgtgaaagaatggaaatcagggtgcttcggtgggggaacggtccatgtgacaaatggaatgcctggaaccgggagggcgctgggtgaggacagagctgcactaagtataaatccatttataatctgtggtctgagaccagtgagaaatttacatcctccattaggttttgagaaaggctcacagattttccctaaaaacaaatgtaataaaaagataagaagtcaccaatcccctgtaaaccttgtcatgtttcaagtgaaaacgtagcccaaagtcagaggcatggacattgtccccagagagatggcccaggcagggggcacgtgggtgctgacgcttatggcagttgaggggatctggatgggctattggaaagagattgccttgctgtagcaaatccctgccagccataatttaaagggacagaagtcattagtctgcaatgtcgctgtctttgtaccaataaaacttgtatttgcctttctttgcaagcctcattgctctgtaactcaatgtcagcagtgagtgagacctgtctcagaaacagtgacaactgcaaatttcagcagcattaatgttatacacgtgcatctggtcttctgaaggttaagtaagttgggctgttttccaagctgcacctttattctcagttctgccagggaaggaaaaaatactgctgatcttctatggtccagaaagtttgtaccatttgttttctaataaaagcaacaataaacttaactcaaaagggaaattgaagttctagcctcttgtttaactgaatcaattgtttgaaatttaatcacaaagcaattgggcaagtttttctctgatttgtttggacgtaatctagcaatctgctgctaaatccttgttctttggaaaagaggtaaattcggcttggagcaccctccttacagcctgcgtgcgtctaaagctctcgtcataatttatgtgaattaccacacatttacgttttcatggaccattttgcctgaccactttgttctttattagtagtaatatacaggatctagcaatcactttttaatatctgaatatttgcataaaatctcactctcgcctcctgtggctcatgaaaatgtttcacacaaaccttaacagggctcttcctaagatgtcctgagacgccgtctagggaaataaacaattctcaccttgttatttatagaatatgtcatattaactcagtacttaatcctctacaattctttctgtgcatgcaacggaacctaatcatcacgactatgctgtgagggaggaatggcccctttattgtacagctgaggtgaataaggtttaagccacacgcagttgaagtcactgcttacaaatgcgtatctagtggggaaattggggcttgatgccattcgtttgccctccacgttttatgctcttttttctgcatgactctgcctctcatgttattatgggtctcacccctgcagtatgtggataatttgactgtttcaagtgtgatgactctgcctctcatgttattatgggtctcacccctgcagtatgtggataatttgactgtttcaagtgtgatgactctgcctctcatgttattatgggtctcacccctgcagtatgtggataatctggctatttcaagtgtggttccttaactgtgactgtaactccatttcagctcctattaagaggtgaaaaatacttccctgtctcttaacttggatggagcttgtgatttcctgtaatcaaataatctgtaatattgcatgccttctaagccctggactcaggatgcctgtggcttccaatattattttcttggaatgtttctgacactgtgtgaagaagcctagaatgaagaccacatggagagagacacctagctgtctcagtcatttcagccttgaaacttaggctcagaaatatgagagccgcccactcagaccttcacttccagccgtgctgcctgcagcctgtcccactgcagtcagcccagggcaggtgagcagaacaaatgccctgtttacctacagagttagcagaaataaaacatggtggttttggtgcagtttgttacacagcagtaaataactgatgcagcaagcattattagaaatcactgcacgaatgcataggcatgtttaaaattcattacgttaagagcaaaaaaaagtatctcatcatgatgcaaaggaaagtaacagtaggaagggttatttcctaggtccaagtgttattatttttatttcctgaattcactatgaggcatattgtgggtcaaagttttaataagattaaaaacaatatagtaggctggatgtggtggctcacacctgtaatgccagcactttgggaagctgaggtaggcagattgcttgagcccaggagttgaagactagcctggtcaacatggagaaacaccatccctacaaaaaatacaaaaattagcctggtgtggtggtgtgcacctgtagtccagctactctggaagttgaggctggagatggcttgaacccaggaagtcgaggctgcagtcagatgagatagctccactgcactccatcctgggttacagagtgagaccctgtctccaataatgataataataatgataataataatatattagtccattattaaaaatcataagggccaggtgcagtggctcacacctgtaatcccatcactttgggaggccgaggaagtcggatcacctgaggtcaggagttcaagaccagcctggccaacatggaaaaacccatctctactaaaaatacaaaaattagccagtggtggcgggcacctgtaatcccagctactccggaggctgaggcaggagaatggcttgaacacgggaggtggaagttgcagtgagctgagatcgtgccactgcactccagcctgagcaacaagagtgaaacaccgtctcaaaaaaaaaccaaaaacaaattataaacaagtttggacagaaatagggtttcagctgcattataagaatttgctgagtcttataaaatgttttttattaatttttattagaacttataatagccattctattggattgaacagcacacattttttaaaaatatattaaaaataataaagcagttggaaagtgaagcaagttgttttccagcaagccccagctttgtgctttcagaatgagcttgaggtcagtcagacttgggttcaaatcatggctcagccgctcactggctttttgatgtttggcaaattgcttaacctctctgaggcttgattccctcaagtgtaaattccttagcatagctccaaattaatgatgagattcatttgtatttaatgtttcccttattttagaacatcccatgcctatgtttcaaaaataaaatagtgcttggccgggcgcggtggctcacgcctgtagtcccagcactttgggaggccgaggcgggcagatcacgaggtcaggagatcgagaccatcctagctgacacggtgaaactctgtctctaccaaaaatacaaaaaattagccaggcgtggtggcgggtgcctgtagtcccatctgctcgggaggctgatgcaggagaatggcgtgaacctgggagtctgagcttgcagtgagtggagatcgcgccgctgcactccagcctgggtgacagagcgcgactccgtctcaaaaaataacagtaataaataaaattaaaaaataaaatcgtgccagaacccaatttggtggctacaatgacaatacagaaaatatatcctccctggtatgcacaagtttccattaattctcttggtttttcaaagtaaacaacaatattgtcttcaaataatattaactttacttccttttttccaattgtcatcatcattattttctactctgttactgccttatgaccttgcttatatgactcaggtcttttaatatgtgttacaattatgaaaagagcttagtaccttgaatatctaggaaaaaataatctgaattttaaaaatcgaatcagggataatggcaatatttcagaagtagtgagatgagatgtgatgacggcaagaactaggaagatatcttaggatatcaaaaggcatgttttagaaaaaaagcaggcaggttccaaatggctgtctaatataccctggctatggctttgtggattcagtggtgacccagtgcagatcacaggccagggcagagaggactacctctagcccagctgagcactttgcaaaaatctcagagaatgaaggttctaaagacagatattctcattcgctagcctgggtttgggatgaaatctgtattttcaaaagtgtcccagataattctttgtatagccaagctggaaaccaatggtctaattggccatgtccaacgaacgaatagacaatctttttaatagatattaaaatgtattataccctaagtaaaaaagaaacccatttataattctccatttaaaagaaagagttccaataatatagattaaaaaaagtgtcacatggttttaaacacacacacacacacacatatatatatatatatatatatatatatatatttttgagatggagtcttgctctgtcacccaggctggagtgcagtggtgtgacctcagctcactgcaacctccacctcctgagttcaagctattatcctgacttagcctcctgagtagctggtattacaggtgcgcaccaccacgtccagctaatttttgtatttttagtaaagacagggttccaccatgttggtcaggttggtctctaactcatgaccacatgatccacccacctcggcctcccaaagtgctgggattacaggtgtcagccaccacgcctggcccgcatggttatatttttatattcttctctagtttgaaacaatgtaccttgtgcaaaatatcttctgttgattattatttgtaagctgcattttaagtttacaaagtaactctacatgcgttctttcctgcggccttcacagcagctcttagacagtgggagtagcaatgcctcacacctgcctagtcttatgcatcttgtaatgcacccttacttcctttctccatataaaacttacatgtggcattcattctctcagaactgaaatatccactgcttggagttctcaaaatatatggtgttgaattccacttttgtgctttttcgtatgtcggcccctctgctgagaatttcattcctggacttttatgcgaattttattcacataaacgaaggtctctgctctgtttgcgttcctggttggattgatcagcaggacaggcagggagccaagccctcaacactgctatggcctcccacatctctgaggtacatcgatagttcccaagtgcagagacaatcctcactgcccttccctgccctcttaggggatttgttttttgcacagaacatataacaaaggaaagaacccagcttcgactttgcatagaattccgttttcaaagctctgttgtccattttcctctgcatcagcaatcctcacacctgttttcttaacctcatcataacctcaacatacacaaaagatggccttagcacaggggcgaacctcttccgaatttcctaggtttgggcatgatcctctcgctgcttcctcagactcttccctttcctcttcctctaccctccccccaccacccaaaatgttgtaatgctagtgactgtgaattacttcatagtcattttcatacctttgcatgtctgtaattaataattaaaaaataaagtgtttgcaaattttagcactttaaatagtattagtgacaaatggctggtcacgtcattattgcgtgtcacgagtcaggaccccccagggtggaatgccagcctcctgccctctgccaccctttgctgcagatgaggcaagcctgctcactccgcaggcttccgctggggctatcggctcagtggctgtggagcatgtctgtcacgcgtgctgtacagttaggccaacgattagtgatgaaggtgacaaatagacactttttgccgtgcactgagggggtcactgttagtaccacctagacaggaatgtctaaagatgctgtcaatgcaaccagcaaatgtcgaatatatttttctcgaagacaaaacagtctaatctcatgtaagaagagtccattcattcgccttgttaacatgtcttagtcctatactagagaaagcataacctgatgtcattaattgaaggatgagactctgtggttatcgtgataataagtatatgtctggtctctgcccctggttcctggcacatggctcttaaaacccttggaatctccagagacacaacagtgtcctttgtatgctaacgagatgactggtggttaaggatccctaactaacatcaagatggggcacagtcaccagaaagaccaaggactgattagtggtcgggattttcagccccgcccccaacctccaggtgagaaagagggctgaaagttgacttggtcaccagtgggcaatgatacaatcaatcatgcctatgtaatgaagtctccataaaaccccagaggactgagttcagagagcttctgaacagctgcacgcagggaagcgtctgaagggtgctgtactcagagagaacacagaagctccacacctcctcccgagtaccttgcctatgcattttcccatcacactgttctgcagactttgtaatatcctttgcaataaactggtaaacatcagtaatgtgtttccccgaattctgtgagctgtcctagcaaattaatcgaaccaaagaggggattgtggagaccccaatttacagccactcagtcagaagcacagatcacaaccaggcgcttacaactgtcatttgaagtgggagacagtcttggggactgagccctccacctgtgggatctgaggctactttcaggtaaatagtgtcagcattgagttacattgtaggacaccctgccgatgtctgctggagaattaactgattggttgttaatggggaaaaattcatacattccttttggtgaccagacatgaagtattcagtgttgcaggttgagcgtaagtatagaaaaaatagtttggttttctcttataactctacagagactccttctgtctgtctaaatttctgggggtaattacactaattgtaaacagctttgtctgctccatctggaagaaagtgctactagccataaactattcccactagagagtgatgatgtgtatggggggcatatggattggggagtggagaggggagtctgcaccctcagccctactagcaatgcaacatttggggaaagtagcgggaagggaacattctgatgccatgacagatatcttttcacacagatttattgtactagttttcaaggtaaactgttttagtagctaaacagaatttctttaaacatgtgggtaccaatttgctcctcgcgcagtgcatgtgatagtgagataaaaaccaatcacacagcatggctggagcacagaaaaacaacattttactttcttttttgagaataaatggctttgttaacacagccaaaacaattgatctttttatttgtattttattcctggtcaatattttaagggctgactggagacttgaggccctgttgggtggaattaaagtttacaacagcccacgttttccatagattatgaaggagccaagcaaacatggtctctattagaaactcaacaacctcagcccctagattaaaagaaaaatcactcaaaagcagacacacaaaatacaggaagaaggaatactgtctagatgtgagactgatttttctaagtctctctaaatttctaagtctgtctacaaatgtgctgatttgtagcttgctcaattatatgtatcatgaaattctctactctacgttctcttcttctttatacaactgtagaacagtctttgtcattcctgttttccaaacccctcaccatccaacactcccttcaactccatgtattcagaaaaaatattcctgaagagtaaaaggcaataaaattcccaaccattccacattacttctttattcagttttgcctttcagtgaagtatgatgtgggacagcaaacaaaataaatgagcgtagatgagaaaggcagtcacttttctcaactccggcaggctctccttttgacaggcattttctggctgtttcagaagttgtcatgcctggtagttgtggcccagacattgaactgtccagagaagttctcgtgctgtccaagcaaaatgcttgcatcctaattccagaatgcacaacacaacatttgtactaaaagggagagtcttcctgttcgatgatggtttcataaaaatcaggtggcactcctattttgttggatgtaatttaaaaaggtcattccgtggctgggcaccgtagctcatgcctgtaatcccagcactttgggaggcagaggcaggtggatcaaggggtcaggagttcgaaaccagcctgggcaatatggtgaaacccaatctttcataaaaatacaaaaattagctgcgcatggtggcgtgctcctgtagttccagctacttgggaggctgaggcaggagaattgcttgaacctgggagatggaggttgcagcgagcagagatctcgccactgtactccagcctgggtgacagagccagactccgtctcaagaaaaagatcattccttcatatatatatgttcatcaagatagtagacaaattaatacagaaaaagagattcttatttcatccatgaagatgcatggatacctgttcttctcacagatacacatatcctatttgttatatctgaacaaagtcttgaatattaaaacaaaaagtggatgaataaactctcgtaacatacctgcaactttagaaacgtacacatgatttagcccttagtggctctacactttcatccagctcgcagagactcagtgtttttcagaaggatcttatgtgactagaaatttaaggtagtgaatcaaacatttgccttactgtagcttaatattttaatacctctagtacattaaaaatagcatacacattcaaatttcattatatatattaaaattaaatttactttgggaattttatgatatcttcaaatcactgaagttaaaacaatggggttcaaacttatttttctattatttataaaataattttaattcatctcatctcttaaacataagacatgataatttatgtacaaaaatgtttaatgcagtgttattcatagtgttaaaaactggaaacaatgtaaatgtgtaattacacaagtataattgtgaaaaaacattattaattttttcggtaagaaaagataaaaattacctatagtcaatgataacacttttgatggtcattcttttctatgaatctgttttttaatttgatttttgaaaaaatattcacaaaaataacttttagacgaataacatatacataatttgctccatgtacatttatcatcgtaaacagctttattctttttttccttgttcaaattcacacatccaggaaggggtagaaccagatcacatatttagagcaatcttaatctaaagctaggttctttctattgactcggggaccctggggctgcgtgactctcataagtcagatcaggtacagaaccagctctacataccacaacgccctcagagagttttcagcaagtccctcctgcaagcagctttattttaaacaaataaataaatagctcgctgaaaggcaaaactgaataaagaagaaacttggaatggttaggatttgtattctcttttactcttcaagaatatatatatatgttctttacatttactgtcttttaactttctcccttcaggcactgaatttaccaggcagccaggattaccaacttagtatgattcactacagctttctccattccagtacagctatatacaaaatagagacacccatacacatttcctgttgccgtttgccttttagaagggttcatacattttatgctgacctttcattagaagggatcatacgttttatgctgactcctcggcttttgctcttctcacttgccagtgcatcagggaggcttctttgtcagcgagtgaaattctaacattcttttttagtgactgtgtatataatatttcatgatgtgtatacatctcaactatttccccactaaagggggtttccattgtttctgattgttttaacactataaataatgctgcattaaacactattgtataaaaatctttaaaacataagacttaatttctatgtcattcatcccaagaagtgaagatgttaagtcaatgatgtatgtcctggccaggcgcggtggctcacacctgcaaccccaggactttcggaggctgaggctagtggatcacctgaggtcaggagttcgagaccagcctaacacggtgaaatcccgtctctattaaaaatacaaaaattagccgggcatagtgatgggcgcctgtaatcccagctactcaggaggctgaggcaggagaagtgcttgaacctgggaggcggaggttgcagtgagccaagatcgaacgattgtactccagctgggcaacagagctagactccatcaaaaagatgtatgttctgtaaactataatagacattgcctaattacattgcaaaatagctggtacaatgtacacgcctcagaaaaaacaatgccttttcagtaaaagtagatgatatatttctatttaatgttggctaatcaaacaagtgaggataataataatgactacatttgagtatcctttctaactttacgacaattggaattttctattttgtcaattcttattgtcatttacttatagaattctggctttgagttacattttgtaagattgccctccattttaatatgaaatattttgagaaaaatattttactcctgtatattctatatttcagaatgtaaaattgatacattcaatgaaagcattcgctaggatttaaaaattgtcatttttaaatctgaaaatcctgcattgttcttggaaactgaatttcatcagtgagcaattggaaaaccttatgaatggcaagttattagtaatgtgaatgaccttatggaaaccacaattcaagacattgtggaaatgaatttggattgtccaaaaatgagacctagaactggaataggagtacaagtttctgaatggtttgtcctcctatattcataactacaacaaggattaaatatttttttcccaaattgcaagtctggaaacatttttcatgattttttaaaaaagaaaacctaacttttttttttttcttctcccaacaagctgaagcttgttgcttgactgaattcttggagataaagaatgtgccctggtacactgaaggggaaaatcagatcacttgcagctgacattactgccaaacgtcagtgaggaggccacagtcagctgggagaattttaccctttaaacatcgtccatgtcgtacttgtggagccactggcttgtataaagatagttattgagaacatttcatagcagggatgtggggaaaccatgcatgtcagaaatcgtttttattccaagatgtgcttcagctctccttctccttctcaaagctcgattctttaaagagattaaagttcagtggtacgaggccgtataaagacatctgaataattccacgatatctagacatttctgaagaaatacactcttttttaaaaagtagcagttatttatcacaattttctaatttatgatcccggattcacgactggttagggtagtaaatatttatgggaagagatgcccctggaatccacttggggaaaagagaaagaaagtcacttcccctttgaaggcagctttactcttccagcatctcgccactgtttcagcgttcctacagctgtttctgctttggacaaatattatgtttttctgaagaaacaccttatttaatgatttaatgttgtaacagtatttagagcctagtaggttctcaataaatatttattgaacgaataaacagactgtcacatcattttattaaatgagttaaaaagggccaaccaaattcatttcttaggtattagacattaaacaccaaattgtgtatagaacaggatgctgggagatgaaagctgtgccaggccttgtagcctcaccgaaaccatttgaaaaatgactaccacttttcagcccagcattttttgctattttggattttcttagttcatagcacctgtcttcatgtcacacaactggaaatgcgtgatcctttagtctctggatttttttcttaactaatacattttagatattacatcagctatatttagcatatccttttcatttatttgtattttcctcatattataggccagtttttacagtcgaatatcccagatttcacattcttataaagttgcataattcccctaattttaaaatatttattcaattggctgggtgcggtggctcacgcctataatcccagcactttgggaggccgaggagggcggatcacgaggtcaggagattgagaccatcctggctaacacggtggaacctcgtctctactaaaaatacaaaaaaattagccgggcgtggtggtgggcgcctgtagtcccagctactcgggaggctgaggcaggagaatggtgtgaacccgggaggtggagcttgcagtcagccaagatcacgcctctgcactccagcctgggtgacagaacgagactccatctcaaaaaaaaaaaaaaaaaaaaagaaatatatatatatatatatgtattcaattaatatttttggttgcatggtatgtcttagatactgaggacgtagaaatattttcttatatgtaaagagtatttacatgattaatctcttcttaaactgccactttgtatattgtgtatttttaattttcatattgaaacacttataaaaatttttcataggatttcttattaaaagtatcatagacctcagcatatcttagtaagacccttgtaaaaacaatgagacaatttgttatcttttaaaagtaaatcagcagcagaataatactaaattaataaaataagtgttataaattttgtgatgctaatattttcaaaatcaatcatatttaagaatgcaatattcaaaacctgccatggagtgcaatttcagggatgcagcttggttattttaggtttagtttttgtatcttagccatttttggaaagctacagaagtcgttgtaaaaaaccacatctattggttgttatttctacatcttcaatttcccataggaatcttataatctagttataaaccgtaatctttcctattcatctagtccttgaagactcaaaggcagtcaatttcaagcaatttatagctaggttttattgcacgactggcagctcaggatgcctcccagaggcacgtgaaactgaccaaagaaagtctccatgagccaaggtggaaggtggtttgaattcatctacttaacttcccatttcgtaagtaagatttccgtagagcccagttcataaagagagctttgtgactgaaacaaccaaaattacatcaaatcagttatgcttggaaccctgctcacttgcagaaaggcaacacaagagctctgtgcagaaattgccatattacatgatacagtttgcactttattcattcacactaacttatagtctatgaagatttaaaatatgagggtttaaagtgatttctaagatgatataaaaacgaagtatttatgtttaataaatttcctctctaggacttttgaaaaacacatatcatgaactaatttccgaccaaacactttataataaaaaaatgaaattgccttggcaaagaagaaaaattgttttcttatgaaatgacacgtttgcttttatacggcacttcagttagatgtaatgattttaatctgagagctgcaggtacatatttttctgtctttctatctacctatctacctgattttgtttacacattttagaattatttgctcaagaaaatgttaaagagaagtgacaaactctaatttaaaatataaacacctcaagagatttgctaaaatagactcaaaatgcattatgttaggaaatatttccacagagaactaatgataagtggacaagtaaaggtaaacagcttaaacatttttgttggttttactttttggcatgatggtgttaaataaaagtctcagtatttttagaaaatgctttaagcagtacattctatttttaaactatatgtctctattttaagtcatagtacgtgatatggagagatcaggttttatgttgcaagtgtattttaaacaacacattcttagtcacacatacattttaatacacattaaatttaagctgtcttactgaattttgaaataatttagtgcggctaaggatgcgttttgttttaagcatattcacaacataaaatatgatttctgaaactcgaataagagaatatttcctacctaggcactaaaaatgtcttaaaaataactcaaaaacaattctaggttcaaatccaagaatgatattaaagacaaaatatccacataggtaataggagtagtgtttattgccatttaatgggcagcagttatgatttctaagaaacttggaaggtccttttatgggaagaggacttgacctgggtcttccatcactcttgaccttttggaaagtgagcgaaagttagccaaaatacactaagaaaagtaattcagccttgtgctgactctttccacaccaaatagcacctatgtaggaagtaaatcattaagctttgaccacgtctacaaggccaaaatgactgcagcatccgcagacaagccaggctgctcatcctcattgggacatgccacacttcaaaggtgaccgagccggtatagtggcacacacctgtattcccagcaccgaagggggaggattgcttgaggctgagagtttgacccgtctggacaatgcaagcgagatccccgttttcaaccaaaacatttaaaacttagccaggcgcggtgttgtgcacctgttgtcccatcttcttggaaggctgaggtgggaggatcccttagatggccaataatctattcagactttgccttgttcatttcttcacttccttctttcattttatttaaatagattgtatgttcacatgataaaaacaattcaagggttttacaagagaaaatgaggttttatccctaaccctccattcttcaatttttttcctccagggacaaaaagtctttccagttcttttttatcctcccatggctatcttacacctggatggagagctacatttagacatcctaatttctttacacctgaattgcagcttattttgcattagtgttctgtacttttttccccactgacaatgtatcttgggaaaaaatgccatgtttctaatgttacacaagtattgcatcacatgtattcggcaagactgattgaactactttaattctgattggtctgtaagttgctattaatctacaacaaataaaggtacattatgaggagtggtgacacaggcatagtcattttcatgtagatatattaacacaggagaaaatacatttcaagctgtggaattactgagccaaattcatgtacattccaacttttatagatattgccagattgccctctttagaggttgtactaacttatatacctatcaataaggtaacaaagtgctgttctccatttgcttgaaggcaaagtactaacaaacttttctgtatttgttaatctgacaggtgaataattgtctctcatatttttactttggttttatgctataattaatgaggttgtatagcttcttcttattccatttgcactttccaatattttatccaacatcctggaacacacctgtttctcctcaatcccccaaaaatagctgctcaacagtccaactgcatatatcttttctcctcttacctttcgttctctaaataaaataaatgcattccccattagggtttggtgcaatcgacgatctttccactttacatcactttattaatttggtttcttactcaccattttcttgtcgaggccacagatcaacccatttattaacaagtctagtaataattgtaagaagtgtagccatctctgtgaagacatcaagaacaactggaacgcggagctccagcttcattcttgtcagtttcttttgagaactttctgtatacagcagaaatatcagtacccatagttcatgaatattattagactttatggattttttttttgagacagagttttgccctgatgcccaggctggagtgcagtggctcgatctcggctcactgcaacctctgcctcccgggttcaagcaattctgtgccttagcctcctgagtagctgggattacaggtacgtgccaccatgcccagctaatttttgtacttttagtagagacagggtttcaccatgttggccagactgttattgaactcctgacctcatgatccacctgccttggccttccaaagtgctgggattacagatgtaagccactgcacctagctaggttttatggttttaaaatacactagagactgctacaaaacactggacactcttcatatactttgttatttctgaaagttattattttaccagtaaatccccatttcctataagctaattagatttatttattgtcacattcaaataattctattatagaatcagtagatactgagtttataggttaaaattgttacaatttcatgtttttaaaaactttgggaaattattattatccctttaaaaataagtatgaaagtattgaattgtttcccctttaacttttaacacaaggaactataagaattggaggctatagagtgtgtttacagttgcagctataagaaattcaggtttatcagtagttactcattagaataatcactgtatttaatctaactacagataaaatataaccttagctatatacttttgtgaggtatataattaacagcatgaaggaatgaagtataaaaataatctttctagaatctacttttaatccaagtcatgtatttggcatcacacagggtgtattgtttaaattttctaaccttggttgtaagtcaacataatttcagaggtactcggtgagggtacatttgaataaggtgagccctctcagaacaaatcatcatgttcaggtacctgaatctgggaagggcttgtgatttagaaatgtatcttttatctatagcatttcagaaaggtgaaagaattttgtactagtatgagtcatactagtagaatgaccttaaaaaattatatgtcctactcatttttttaaaaaaatgctttgttcctacaaattcccaaaaaccaacctatcagttaatgtaaatataatacataatgtatcaataataataatcaagcttcagaattggtggtttgccttgaaaaaacatatatgcacttgagaaaactggaatttttttggacaaaacattaaccttcaaacttcttttgttattgtgggggccaagggaaaacttctcttttgccttctgaagatttaatgaaaatcaattgacaaaagacaatgtaataggagaaaaggcatacaaatttattaacacacgcaggaggcatacaaaatacaagagcaccaaaaaatgtccagatagttgatgcttttataccatctggaggttacagaaagtatataagcttggatcttgggaaaacaggttatggtagtaaatcagctttagacaggacagggtatgggaggcagagaagaggaggcctggcctggcctgcaaaggtggtctcattacgtagatgaaacctcccaggcagcaggactcagggggaatagatgggaaatgtctcttttggacctttaaaggcgtcactctctgccaatcttttctagatctggagaagggagggtctcagagaaagccaggctgcgtggatgtggattttccctgcaggtgcaagtcttcccaacagaagacctttgcagggctgcccatggtcacaggccctctgaacatccatcttaaaatatatcaaagaagggtattttggggtaaaatattttggtttccattatttcagtcatcttatattctttttatcttgtatatttgaagttcctactttcttcgttctacttgtttctttcagtaaaaatagaactctagtgcttggccttgaaaactgctgctagtgaaaagaatctcacagagataaggagggaaaattttgcttgctcttgacaaccgccaataaagcgtttcttacatactagcaatttctttgagttgccctaattcttccttgataagtgctcaagcctgtggtcatccaaaacctgttattttcttttatcttttctatagctgatcctacggaataaagcattgttttggtattaagaatatgtaggtgtcagattttattgaaatacatataaacttgcaaaagtttatctccgtcttatgtgttaaataaaaacataaagattaatttaggaaaacagaaaaatattaaagttcatatgcagttttgaaaactatttctttaccattcaaattaccaatatggcattatttatgattacgagagtattctatgttaaaatgtcagttaagtaaataattttattggttttctttataaagaagtactttttgtgataaaaatttctttaggtttaaacaggagaatctatttgtgtgagactattctcgcattggtatgaagaagtacccgagactggataatttataaagaaaagaggttacattggcccatggtcctgcaggctgtgtgggaagcatagcagcttctgcttttggggaggcttcaggaagcttccaatcctggcagaaggcaaaggggaagtaagcatcttacatggtaggaacaggaacacgagagatgggggggaaggtgccacctacttttaaataaccagatcttgtgagaactcactatcactatcacgggatggtactaaaccattttttgagaaattcactccatgatccaatcacctcccactgggccccacttccaacactgggaattacaattcaatgtgcgatctgggtggggacacacatccaaaccacatcactattgttatctgtaaaaatactacattacaaatcttgtaaatataacaaagggcaaattaaagtttgatgtgctatttgaagttgtttcctattacttctgagggacgatggtgttacaaattggcccctcttaatgttaacataaataaatactagctttcaaaactaattatttgttcacagtttcaactcagatgcagcctgattttcaattttaaatagtactttagtttatagtaccgtaatagaaattagcccaaataacggagtagcttgcaagaccccaaagacacatttacattctgacagaaatgtaagtattggtttaaaatgaatctttacatttgaaaaatctaagtttatttacctaaagctattaatttgaacatacgtagaggttcagtagaagaatatgtatggggaagggtttccttcaccctctgaaagttcactaaaaatcaacaaggcagattaattggagaaacacatacaaattcatttaatgtgtctacacaggagccttcagaatgaagactcgcacaggggaaactgtcattttatgcttagatttaacagtgtatggacagccaggtagaaatatggagggacacaaagggtgtgatctactgttaatagacggagcggggtcacccagcaaggcctgtctctctagactctttctggcctctctgagcagcgtccttccttctggggtgggacaagacctccctggaatggggattttatgtgctacggtcaaaaaatttctcaattttctggccagcttttacacaaaaaggcaaagggaaagttcgagtaatacttgtaggttttatggctggatttggggaaaggggatctggttggttaaaagaaaagcctttgccaaattaaattgaacagagtttaactaagcaaagaataattctcaaattgggcagcctcacaacccagagtagcttcagaggctccggcacaaccatgtggtggaagagggcttatgggcagaagacagaaagaggaagtgcaggaacagaaatattggagacagctccatgtttgctttatgtgaacacagtttgaacagttgtgcttcttggattggccaaaactcggcgattggcacaagagtagattacagtctgattacagtctgtttatacctcctttaggttatagttcactatgtgctacaaaacctttaggccgaacttaaaatatgtaaggaggcagctttaggctgaatttcattcaacaggtttgtaaaccaaaagtatctgagacatgtctcaatcaagttagaagtttattttgttaagtttaaggacaagggcccatgacacagcctcaggaggtcctgagaacatgtgccaaggtggttgggtgacagcttggctttatatgttttagagagacataagacatcaatgagtatatgtcaggtttacattcgtttggtcctgaatggcagaacaatgcaaagctgggggtggggcttataggtctaggtggactcacggatttcctgattggcaattggttgaaagggataagctctgcctgcaaagttggagtcagcttgagttaaggtaaagggggttatgaagccaaggctcttgtcatagagaggcagcctccaggtcgcaggcttcagagagaatagatgtgaggccgggtgcggtggctcacacctgtaatcccagcactttggtaggccaaggtgggtggaggtcaggagttggagagcagcctggccaacatggtgaaaccccatctctactaaaaatacaaaaattagccgggtgtggtggcaggcacctgtagtcccagctgctcaggtggttgagacaggagaatcacttgagcctgggaggcagaggttgcagtgagccaatatcatgccactgcactccagcctgggcaacagagcaagactacgtcttaaaaaaaaagaaaagaaagaaaatagatgtgaatgtctcttactcaaggtgtcagactctctgaagagacctactaaaggaaggaatagtgtctggcatattataagcactcaataaagatgtgctgtgaatatttatgagatcgtcaaagagttctcaaatcaatagtgagaatacagcttttcaaatcagcattatgatgtattatacatcaacattttacccttcctcaaacggtgctttacgtgtgggaaagaaatagctgtatttattcaatggtggattttcttcattgcattccattcagtgtctttcaatcgccagggaaacagcaggaattctcgcacaggacaatgcgtcacgacctgtggatccagcatgcattgttgcattttcccaaatgcacccagtgaaggagaatatgataatgtgaaaaacatttcacaccttgtaaacatctgaaagtggatttgacaggaaagcctgcatgttaaatcgaagatagtcttttgattccgtaaccattccgtgaaccattcgatgcagaaaaatccatgctggagaaggctccactatgcctaatgcaggatactgatggaagaatgaattattctaccgtatgttgtttaaaaggtattaaaattgtattaggaggagtggctctgtctatagccgtgggtcagtgctgacagaacttggtggccacagccagctaagacatgccaccatggggaagtaatttacgagctatggaacaagagctgaatttatttgttttctgaacctctttaaaaaatacatacagctttattgagatacaatttacttaccataaatctacttgtgggtgcaactcaatggatttttagcatacagagtgtgcaattaccaccatgatatgatatccgaacagtttcctcaccccggaaagaaatctcatgcccatcagcagttgctctgcaaacccagctcctcccatgttcttctccttcagctcccaaattagacaatcctgaatctgctttgtgtctctatggatgtgagtaatctgggcatttcaaatagagtcacatcatatgtggcctgtggtgactggcttcttttgcccggcataacattttcaaggtctatctatgttgtagcatgtaccggtagttcctcatttttatggcaaaatattccacatttagtgtgtctgtttcttagttgacagactttgggttgttttcactgtttattataaataattttgctacaaacacccatgtatgagtttctgtgtggacacgttttcatttctgttgggtatatatccaggagcaaaatacttggatcatatgggaactttatgtttaatcattaaagaaacctctagactatattccaatgtgactgtactgttttattaggttggtgcaaaagtagttgcggtttttgccatttagaagtactgacaaaaccgcaattacctttgcaccaacctaaaacatttgcaccagcagtgaacgagggtttcaatttctcctcattctctccagcacttgtgtttgttatctttttggtgacaccattctcgtggatgtgaagtggtatctttttgttagtttggtttgtagcacatgttgaaaaaacaattattttctcattgatgtgtctttgcctctttgtcaaagatcaattaaccataaatgttaggatatacttctagagtttccattctactctgctggtttgtccatccttatgccagaatcactctgcctggattaccatagcttgtagtgacttttgaaatgggtatgtgtgagttttccaatttcttccttgtttctcaggattgtttagctattctttcatttaatttatgtaactttagttttatttctagcaaagcaatacatagccatagtttaagaaattgaatacaaataattaaatgtgttttcatatttgtgacttttagatattatctattgccatccttctaaagaaacagcatttaaatttattatccatctaatcatacacacaaatacatcattttgctttttctcatgaaatatatattatatatacacaaacatacatagacatacatacacatatagtgtgtgtatataaatgtggatatatatatttagatatacatacacatcccagttatatatgcgatacacacacacacacacacacacacatacacgcataccagctatgtatagggagtatatatatcccaatgatttcttgtctaatcagtattgaaatatttacattctttgggctatttaaaaattacttgttactgaatcattttttgtacaatgtacataattttgttcttgtgtaacattttgtacttataggtgaatattgcatttttattcttaaatttcatatgcacatatcagaaatttttcctctgatatattactctaaaatatgtataatattttaaatatggcagaatatctaattatttataagattatttacttgttctttttaaattttctttgttatagagacctaatttccgagtcctccatct

SEQ ID NO: 691 - DNA, 112133 bp, Homo sapiens
atagaaatccccgcagggaaaaatctgaaggtatctggtcttatggactgtataattaaactttcttatcattgtacctaaaccaaaatatgcttcctatacaaagaaggtttctttcaagagttaagactgcctcctgccatcctccttaacacacacacacacacatgcacacacacacacacacacacacacagagagagagagagagaattgagagcattagtccttttctcccttagactgattttttcttactgttattttcagccactttgttaacggtggggttaaagggcaggatagatgtaacacccatttcacatacatattgcaacatcagagatgctggttttcattaaaaacaccagatctaaattccttctaaaatatattttaaaaaatcagtacacttggcaccttggaaatgctgaaatgttatcatgaatgctcgttatttgttatgagtcaattgaatattatcttcaatataaactataatttactggtctgatagctcttcctatcttacctgtatatactcaaagggagcgatttctcatgtttagcaaattgttctttaggtaatttgttctttaggttttttgtacaaaagtacaaaatagttatcacagcaaactttccagtatttgttattttgaagctatatggtttttttttttttttttgccatgtcaggcttgagcaggatagcaaatatataaattgagctctctaattataatctcaatatatgaattcttgctaattaaaatactttgcaccagcaaaaacaattttcatgtatgtgtttaggaggtagttaagtaactctatataaaaataagtgcactttcccctcctttcttcagtgactagaaaacgtccatatttttaaaataatcaaataataattttagagagcaacagccctcaactctttgctggtgcttatcacactgcctttcttcactccattcttagctctgctagtttcttcttgtctgtaatgataataagggaatgtgggtgggtcagcacttctgtgtaggtcccctttccaaatttaccttccaaaaagccaaccaaataaacaaccaaaaaattgtgcaacaaaacacaaatagcgttccaatagcaagtgatgcattcacctgagattaagtggttttaggtggtcagtaacaaaatgctgctttgctgtcatagtagaaaggcaacaaattcttcaaagaaaccaagaaggttacaaccttgacaaagtctctcattaccttcctcctcttgtgtcttttttctccacattatctgttgcgtatctactatagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcagtgcattttttcatgttaaagtttttttcaaagctaaagtgtgttccttgttgtgctgaccacaaacgagttttaagagttttgaaagtctggcaaaaatagaaaaaaaaaaaaagctgtagtgacattgaactgctcaatgtaagcattgggcatgcacaaattttcaaaacaaaggaaggaaatcatccctcttacaacatggttaggctgatctttaagaaataaaatgtaagaaattagaaaagcaaatgtttggcacctacatatccaatatctggcaccgtgcagagtagaagagtgaaagaaataacgaagaacaaagtggttactttgcttcaggagttcatgatctgtagttagaaaccaatataaacattgtgagtatatttcaaagaaagagaaaagcaggccgggcatggtggcttgcacctgtagtaataacgctttgggaggccaaggtgggaaaattgcttgagctcatgagtttgataccagcctgagaaatatagtaaaacctcatctctataaaaaaaattaattaaaaaaaaggcagagcaaaaacaaatatgaaagaaaacattagaaatcagagcttgggcaaagagttaaatgtgagcaaagcatctctgccttggggggcctctggagcatcccggcttcctgtagaggccccaccacatggccctttcccatcactgggaactgtcttctgtatcgtgccaggattttcccccaaacttctcaacctaatttattcagccaaaacatatatatttcttgaatccttgctaagagcaaggcactgttctacataatgaaaatatggcaatgatataaaacaaaaatatttaccctcaggcaaattacattccagtgagaaaagacagatcattaataaaataaatatgtaaaatatagaatatgccagaaggtaataagtggtacagagaaaaattaagcatggaagggagctcaggaatgctgggagtgggtagatgtgaaggtagttagaatgctcaaggagggagtaataggcagaagaatggcctttctacatgtccatatccctatatggcaaaaaggacttgtggatgtgatgaagttatggatcatgagatgaggagattattctggattacccaggttggctcaatgtcatcacaagagtacttaaaagcaaaagagggaggcaggagagtccgaggcaagaggcgtgacagctagggtcagaatgacgtggtggctgcctggaagggggccaggagccaagggatgcaggcatcctctcaaagctgcagaaggtaagaaagtggtctctctcccctagagagagtgtgtgttctcttagcctactagaggtgtgttaatttattcctgcagtcatagaaaacatatagaaggtctcactgagaagacaacatttgaacaaagattccaaggaggcgagggcaccagctatgcagatatctggggaagagcactcgaggaagaaaaggcaggcaaacagcagggtgcacacctagcccaggtgcatgaagtagagaacactgggagtcagaaggctaacaggagacaagtcagagagagggactggggtgggtcaactcacactcagcctcactggctactgtaagaacttcaagttattctgagacactcagtataggagagtctatgaatatttatagaaattctgaatgtttacaagacgaataaaagtggtatgctagtaaacttattggttgggtggggagaagcccagatttgtagcatttgctgatttccattgtgtaaatatttctactgatggtttgacaaacacttcataaaattcctgggtacttaattatcagctccagtagagcactgcatgtatgacatcccatttgccaattccacactagattctgttggggacaagctgtatgagagtcaactagcaacagaaataaggaagtcctcaataaaaatcagcatttacttttgacagatgtgagattctggaatgtatttctctttacttgctctgcctggtgattaaattatgattttaaaagaaatagttttaattccttatcagaatgctgccaccaaataaataaaatacgtactttaactatatgcaatcttgtctatattatactgttgtcaacggaaacattatcaggggccagcttcatgaaaggagatatgtgatagaagctggagttgttggagtgaaaaaaaaagtcaaattttactttggattaatcagagggaagaaagcagacagataggaaaggaaaggcaggcttagccaagttgaagaaagaggctgaactcaggaggcagtgggagaataggatcatagtttgaagagagctgcaaggctgtttagtccaggtgaggatcataatcccagaagacccagtcacaaacaccataaccctgaatgttgaaatcctgaaagatcaaaattcctaaggtctaaattcatttctttttagtagagatggagtgaattagttcattcttgtgctcccaataaagacatacatgagcctgggtaatttataaaagaaagaggtttaattgactcacagtttggcatggctgggaaggcttcagaaaacttacaatcatggtgaatgcaaacaagaagcaaggcactttttcacaaggcagcaggaggtgctgagcaaaaggggaaaagccccttgtaaaaccttcaggtattgctcactgtcatgagaacagcatgggggtaaccacccccctgattcaattacctccgactgggttcctcccacaacatgtagggattatggaaactaaaattcaaggtgagatttggttggcaacacagccaaaccatatcattctgcccccagccccttccaaatctcatgtccttacattttaaaacatgatcatgcctttctaacagtcccccaaagtcttagctcattccagcattaacccaaatgtccaagtccaaattcttatcttagacaaggcaaggcccttctgcctatgagcctgtaaaatcaaaatcaagttagttacttcatagatacaatgagggtataggcattgggtaaatacacctgttccagatgggagaaattggcccaaaatgaagggactgcaggccccatgcaagtccaaaattcaatgggtcagtcaaatcttgaagctctgaaatgatttcctttgacttcatgtctcacatccaggtcacgccgaagcaagagttgggctctcatggccttgggcaacaggggtgcctgttgatttgcagggtacagcccttctcctggctgctttcacaggctggtgctgagtgtctgtggcttttccaggcatacggtgcaagctgtcagtggatcaaccattctggagtctggaggatggtggccgtcttctctcagctccactaggcagtgccccagtggggatggtgtgggggcccacatttcccttctgcacacattgccctagcagaggttccccatgagggctctgtccccgtcacaaatttgtgcctgaacacccaggcatttccatgcatcctctgaaatttaggcgtagattctcaaacctcaattcttgacttctgtgcacccacaggcccaacacctcgtgtaagctgccaaggcttggggcttgtaccctctgaagccatggcctgagttgtacattggccctttagccatgattgggacacacggcaccaagtcctgagactgcacagagcagcaaggccctgcaccgggcccatgaaaccattttttcctcctaggcctcctgtcctgtgatgccttgagctactgtgaaggtctctgacataccctgaagacattttcccattgtcttggtgattaacattcagctcctcgttacttatgcaaatttctacagctggcttgaatttctctccagaaaatgggttttccttttctgtctcatcatcaagctgcaaaattttttaaacctttatgctctgcttcctcttgaacactttgctacttaggaatttcttctgccagataccctaaatcatctatctcaagttcatagttccacagacttctagggcaggggcaaaatgccgtcagtctctttgcatagtaagagtcacctttactacagttcccaaaaagttcttcatctccatatgagaccacctcagcctggacttcattgtccatgtcactatcagcattttcctcaaaaccaatctgcaaggctctaggaagttccaaacttcctcacatttttctgtcttctttcaaaccctccaaactgttcaaactctgcctgttacccagttccaaattcacttccacatttttaggtatccttatagcaacaccccactacctcagtgccaatttactgtatcagtccattctcatgctgctaataaagacatacccaagctgggtaatttataaaggaaagaggtttaactgactcacagttcatcatggctggggaggcctcaggaaacttacaagcatggcagaatgcaaaggagaagcaagtcaccttcttcacaaggcggcaggaaggagaagtgcaagcaaagggggaaaagctcctcataaaaccatcagatcttgtgagaactcactcactatcatgagaacagcatgggggtaactgcctccatgattcaattacctcccactgggtccccatcatgatatgtgaggattatgggaactacaattcaagatgagatttggttggggacacagccaaaccatatcatggggtctcactttattgccctggctgatttcaaactcctgggctcaagtgaccctcctgacttggcctgccaaagtgttgggaatacagacatgagctaccatgcccagtcctaaagtctaaattcttaacatctaaaatccagaaaatcacaatcacaggagagttgtaccacgttagttgcatcatgttaggtacaactcttgctttgttttcttcttatttggaaattatgtatggtttaagggggtccatatgggtgccaaatctacaaggggtggacttgcagacttaatttcaggtgtcaacttgactggattaaggaatccctggaaagctgggaaagtattattttgggtatgtctgtgatggttttctcagaagagatcagtgtgtgggtctgagcggactaggtggggaagatctgctgtcaatgttttgaatgtcttgaatatcacagaagtgaaaatgaaagtaaaaaatgcacaaaatcttgtctgccaaattatgtaatcatgtaccaagcacctctacacgtagcaccatgcttgtcttcacaaaatgccttttgtcagataataaaaagagttcaacaaattcagtggccttctgaaccagacacctgctggcacagagcttcctccagtgctacaagacatattaaatcatgaactattcttgattagggatttgactgtcaaaaaagataaacatatttatttaccactaagtctaacataacaaaactggtgcatttttcactttggctgatgaatggcactttcaaaactgtccccagtgggtttttataatcaactttatacagtttatgcccccaatgaattacaaaattctataatttaatcttcatgtttatggtttaataactggaaaaagtgaagtactttataaaagcttatttgaagatttggagggctttgcagaagaaaatagatttcaatcagatccccaaattataatgacaagtttttaattaggtgtgatcaaggcttctaaaagtgaattgcaagttgttaccagtaaagtttgtatcttccattcagcccagttcatttgccagaaaattcaggtgagtggattggccaggccatatggcaatgatgaaaattttagttttaaaatgtgccatttgtctgtattggcattccttccacctgataaaactccaggagcttttgataaattaaaaccacaattgcctgaagaagccagaaaaattacatactagtttgaaaataatgatgtgcaaggtgggataagaagtcattcaggcaacggtgttgctgttcaatcaagagtattgtttctgccaaatgagtggcctgtatatgagggcctgcaaaatggatttccacatactcaaaacaatagacaagaatggcatagaagattggaaaatataataggaaatgctcatgtcagtgtgtatcaaattatagaatttcaaaaagagcagtgccacatagaaaatgaatgtgaacatattttatgaggagagtcaaatcctaaaaacaaaaaaggcatcatgatgaaagacttcaaaatacagttaatgataatgagagtcagccagctattatgaactctgcaattgcccataatctatccatgtaatatactttttatatgtcaattttcgttttagttgtttctttttccattttttccactattttaaattgtcagcattttttacaacttggtatgctatgtatttcatcttagtatcatttccaatactggaggtataaattttgcaaagacttttagagagttctaatttgttttatgcttttatttttgcaaatttgactccacaagagtgcattatcacaacactgactttgtgtgtaagcattgtacctgtacataaaaacattaaagcttcctcaataaatgagaagatatcctttttgcacatttgtatttgggaaagagaaaatttctcaagatctcagctctttgactgcatattagatggtgacccatcccagcttttgatgaatctggtcaaaagacttaggttgtctgtcacagtattccagatgacctaagttataaagctgagtgcacccagttaccaaccatgcttttatacattttgctttttgacccatttctttacgagtacaactcatctgctcattactgttatacccataagacgctctttagcatacctgagttttatgcttgcaaatatatgtatgttattattgcctattgattgtgtaaagtagcctaggaagtgttctgttgtgtttttatacgtttatcaaataaattccatcttaaaaatataaataaatgcttttttgttgtttttagacagagtctcactgtgtcacccaggctggagtgcagtggtgcgatctcagctcactgtaacctccacctcctgggttcaagtgaatctcctgcctcagcctcccaagtagctgggactacaggcacccatcacgatgcctggctaattttttgtatttttagtaaagatggggtttcaccgtgttggccaggatggtctcgatctcctgactttttgatccacccgctttggcctccaaaagtgctgggattaaaggtgtgagccaccacgtcctgcccaataaatgctttttaaagaatgtgttaataatttttttccagaattgtattttcagaattttgttttttgaggattgtaattttcaggattttagactgtacagatttagatcttttgggacttcaacatttgggattatgacgttcaggattgtgtcttcctgggctgtgacccaaacccatgtggtccaacgctatttcacatgagaggaaagcaaaccacgtgcacagatgcaatgaaggcttaaataggcgtcatgtattgattatatccctggaaaacatgattaagatgatacgtagcgactttttttttccccagtgaaaaagatccacattctttttcttgtgtggaactaaacacaatttctgaatcaatgtaagtgaatgtgaatcaccatgttcacttagctgatgctcctttattaacggggatagaagggacgtgattcaaagagatggcggcacaggacccatgacctaaggaagctgcagtgggtgaaggggagaaacagaggagcaggggctggagaaagagtggggagtcatcaactaccctccttgctcccggcatctggtgtttggagcccagaggtcttctctaaggcctcggagaagcttccaagtctgttcatttctctttccccacccctgcttgtatcacaaataaagaaattattgacaactgagttcctgactaggtggcaggattttagggatccttcacctcgtccaaacctcatgaaggtagtgggagtcccatgggttagttagcaatagtccttgagattatttgttcatataaataatcacaatactcatagtcatcttgcttttctcataatgcccagctgggggacggtgggggcagagaggactggagtgagaagagatagaacaagagctggctttcatgtatggggctctccagagcaatcaggcctaaggacaatcaagagggatcttgaagcagctctggcaagggcagcctggactcaggccccagcttgcaccaagcacgtcacctgtccaactgggaagcctaagcaatgtgtttctgtttttgttttgttttctggtaaagaattcaatgtcgttagctacattcacaatgctgtgcaatcatcaccactatccatttccagaacattctatcatcccagacaggaactctgtgcccattagacactaacctcctgccagccctgaaaacctctattctactttctgtctctgttaatttgcctgttccaggttcttcatatagatggaatcacgtagtctgtgtctgatgtctcacttagcataatgtttttaagttttatctatgtggtagcaagtatcagaatttcctcccttttcaaagatcactaatattccattttatgtctataccacattttgtttatccatctatccctcaatagactttttaggttgtttccaccttgtggttgctgtaaataaggctgctgtgatgctgcaatgaacacaggtgtagcagccaggtgtggtggcatgcgcctgtagttcctgctactcaggcttctgaggcaggaagatcccttgagcccaggagttctgggctgcagtgtgctgtgttgatcagatgtctgcatgaaattagacattagtacagtgacctcccgggataggggactaccaggttgcctaaggagtggcgaaccggccaacaggggggtcgcgcccgtggacagccctgcagagggggtgggggggaggcggggttgtcgcacccgtggacagccccgcagcagggggctcgtgcccgtggacaggcctgcagcgcggggcgggggggcggggctcgcgcccgtggacagccccgcagcaggggatcatgcctataaacagcccctgcactccggcctaggaaacatagtgagaccccatctattaaaaaaaaaaagggtacggagagaacacaggtgtacaagtatctatttgagtaactgctttccattcttttgaagataggtataggtagatatagatacagatatagagatttacagatatgagtgggattactgaatcatatggtaattctatgtctaaatttttgaggaaccatatgttttccacagctgatgtactatttttcatacccaccctcaatgcacaagagttacaatttttccacatccttgtcagcacttgttattttctgggtgtttttgctttgttttgaggccaaatctccttctgtctgcaggctggagtgcagtggcgtgatctcggctcactgcaacctgtgcctcccaggttcaagcgattctcgtgcctcagcctctcaattagctgggattacacatgtgtgccaccatgcccgactaattgtgtgtgtgtgtgttttgttttgttttgttttttggtacagatgaggtttcaccatgttggccaggttgctgtcaaactcccgacctcaggtgatccacctgcctaggcctcccaaagggctgggattacaggtgtgaaccagcatgcccagcccctgatttttttgttttttcttttttgatagcagccatcttaatgggtgtgcaggtgtgtgtgtgtgtgtgtgtgtgtgtgtgtgtgtgtgttttaatgtcacattggtgattctaatgtgtaaccagcaaagaaaagcatggattctgggtctcaatttttcatctaggtaaaccagagcaaataaaacctatcgaagagtcctcctgatgattgaatgagttcccccatagaaggcaaaatttacaaatgttggttcctctcttattcccttggaattctactaaacttcctgcctcaacatacagagaaactccctgaagcctaaaactatgcagatttgacatagggctgattttaacttctgttttgcttttaccatatagctagctgcagaggtcacatgtgtcctccatgacatctaaatagcactacacctgcaccagctttcctctcaaattaactactcatcagttctattattaaataaacagggagcagctgtaatactcaaggagtgtgtgggattgtgctttaaaattacatctctgccaacactttgtttgcttgttgaataactacaagttttccagttaaattaatagaatacattatacccataaaatcctgacatatttggcaatacacacaacaaaatatttacaagtagagaatataataaatgtatgacactttagaaatgcattgagataagtttaaacagtgtttacttttaattggtgtgctttctttcatctcacagtaataagctatggtttagtttatcggctgaatactcactatgcagtcctttgtaaaattttggaggtccgcagtaatgtgattattgagcttcaacagaatacacagaagatcccaggaaccacagactaatccatccactatgcagtatctaaagtatttgcaaaaataaaaacaaacaacaacaaaaaaacacctgaacaattgactcgtagcaaaactatcaggttagtgcaaaagtaattgtggttttgccattgaaagtaatgaaagtaattgaaagaataggtgttctagctggacattctacaatgcatgccacaaccatggatcaattgtgtattgaaaacccaaaccaactgaggatcactgctgtgcattattcccatcgtgtcataatgtggcaaactaaaactaaggacccataacaagggattttcagagggaaagcaaacatattggttaaagcaaacaaaactggcaattttcaatttgctcaaactattcacatagtttgtatgcttctctacaaaatacagaattttgatataattacccttaggtaaaactctaaagtgagcagcttctgatcaataggcctcaactccttttcccttctgtatcacagactgtgtgggtgaatccaacacatgacctaatacgatttggccagttgggaaaggtctctttaaagaactaaccctcaggctgggatctagagcaaagcaccgtaaacttgaatgtgcataggaaccacctggggaccttgtcaacatgcagattctgattcattggatctagggtggtgcctgagctctagcaagctcccagggatgcctatgtgactgccttggacatcagttacagtagcaagaatataagcagataccagccaacaaagcaggagtgaacgcatcacggcccaggcagccctggaccaggccagctcagggatctgagaaaagagtaactggactgaggtctatgagtgctgccatgagaggtgaggctgagaaggtggacaagatctaggtcaatgtgttaagttcctactaaatgcaaggctaggctctgcataaacagaaacaaataaggcaaacctactccttgcatctttagagcttgtggtctagcagaattacttcatgggtagaaaatcattaaagatttttaaatgaaggagagacatgatctaattgaaatttttgatgaacctctctgggtgtgccatagagaaggtattggagaggcaaaaagttggaaagaggagtatatgtttgcagaccaggtgaaacatgcggatgacagaagtggataattttagcacatattttgaaggtgaaataacaggacttggttgcaagttgtgatggtaggggggtggcaggaagaagaaagcatcaaggatgatgatgctttctggaagaagcaaatgggtaaatggagataatttttacgaagaatggtaaggctgaagaagaaataaactaacaaaagggaaatgattgaggaagtggcatagatttgggggcagaactcaagagttttgaattctgattttaggaatgcctatgaaaatcccagtggagatttcaagatggcaggtgcacataatgttttggagcttgggaggagagctctgtaggagccatatgcatataaacagtatctaaagccataggaattaataaaaccttgtctagagtctgtgtaggcacgggcgtccaatcttttggcttccctgggctgcactggaagaagaattgtcttgggccacacataaaatatactaacattaacaatagctgatgagctaaaaaaaaaaacataaaaaaatctataatgcttgacgaatgtttacaaatttgtgttgggctgcattcaaagctgtcctgggccacacgtggcccacaggccacaggttggacaagcttagtatggaataagaacagaagaggacccaggatttaggaacttcaacatttaaagtttgggcaaagaggcaggagctgataagaaaatagttcaagctagaggaagagatcaggggtctactctactgaatgtttctgagacgccattggacttatatattacataatatgtacaatatatgttacttgggtgatggataccctaatagctttgaactgaccactatgcacggaacaaaactgcacctgtatcccgtaaattttatataaacaaaagtaaataaatagaaggcaggaagggagaaggagaaggaaggaaggaaggatggaaggaaggaaagaaggaaggaagaaaggaaggaaggaaagaaagaaggaagggagagcgaggaaaggaaaggaaagggaagggaaggaaagaaggaagggagagtgaggaaagggaaggaaagaaggaagggagagcgaggaaaggaaaggaaagaaaggaaaggaaaggaaaataaatgaaagggagggaaggaaggaaggaagaaaggaaggaaggaagggggaagagagagaaagaaagagagagaaagaaagaaagaaagagaaaggaaagaaggaaggaaggaaagaaagagaaagaaagaaaagaaagaaaggaaagaaagaaagaaaagaaaagaaagaaagaaagaaagaaagaaagagaaagaaaaagaaagaaagaaagaaagaaagagaaagaaagggagaaagaggaatagtgttcatgatgtttatgaatcaccaattctgggggcactgaattgtgtcccccaagattcctatgttgaagagctgatccccactgcctcagaggggactgatttagagaaggccttcaaagaggtaagtgaggtcaaatgaagccgtatgggtggaccctaaaccaatatggcaggtgtccatctaaaaagagattgagacacaggcaacacagcctgaggacacagcaggaagggagccgtctgcaaggcagcagttctcagaagaaggcaaacctgctgacattccatcctggatttccagtcttcagagctgtgagaagataaaccactcaatctgtggcagcttgtgatggaagcccctagcactcttatatggtgaccttagcacaagcagtttaacaggcttggtgaaagtgaaagccaaactgacctgaataaagagtgaaaggaaaaggagcaaaaggagacagtaagtgtggaaaatccttgaggaaaatttgccaagaaaggaggagatggcttgatagctagaaagacatagagagtcaaaggtaaggtttctccaagatagaagatttttttaaatgaaaaatttatatttaaatgctgacagaaggcatcaaggaggagagagattgaagatgcagttgacaaatggaaaagcaatgaacagaatccctgaaaagtcaggaaaagaagggagattattagagggatgtccttttacagtaagaagaatacttcctccaccgccccaggatttaaaaagcttataaatgacaggtaacattctacctaattatagagctttacacttttcaataaattttgttgtacatgatacagtcactctgtgaattcagtgagacagacagttatccacattttacataaaaagaaagaaaaggcagaaaagaagtgatttgcttgaagtgacacagaaacggctggtagaaccatgcactgtgtagatggcagggctcctgacttctcatttcacaccacaaatgtagacagaattagatataatgacagttattatatttttaaacctttcaaataagaatatccttagattttcattcattaacaaagcacgtgattagcatctgaaaatgttttattatacgatcactagacaccaaaagaggtttccattttcctgtgtatttgaaagagttcaacagccctaagtcacacagttggaggaaactcaaacaagagaaggttcgtttgaagtgatgaaattagcatgatgaagtttacaatacaaagatttttgtttcaagactctgaggtttggtagggaggaaggggaaaggcagatgacaccaaataggactggttggagaggggatgagaagcatcaattagaaagctcttcaaattcaaatggactgttcaaaccatcctaggactagactccaattgggaaagactctgaagaaaatgatctcctactcccacgagatggctaacgtgatttaggtaaaaagcttttagttttatggctggggaggtagcaataaagaaaatgaacttcctgccagtgattctttgtcaagccctgccaatttctgtgtctggggaagctataaagaatgtccagcctcatgtcaaaagaattgccacagatctccagcctgcctgcattcaagcatcgaaacatccctaagcctgttcccaggccagcctggaattgagaatccaggagagtcttttctgttctgctgctgcagctacactatctgcttgttagcataaccagggccaccagcaatagatgctagagaaatacacagagaaaaaatcaacagctgatgaaaagcagaatcttttctttttggcagcaataccaatagcatgaagcacatcccttttggagctttccaaaccacttcaaaagcgagttttctggtgtggatcaagaaagctaggcaaattgcccctgagggcatagccactggccaagatattgatgagtgtaggcagctcaggacccatcctcggccccggtgctgtctttctcagagctctgtttaattccatcaggcatgggcagcgtttggagaaagctgtgttcatttttgtgatcttcagccagcacggaggtggccagttccctagcctcccagcaccgtcctcctcctgccctgccccttcatggcctgcctgggctcactggacccacacttgcctttcacccctgtcaaagcctcacagtcctgtgtgtctgtttccctttgaactacacaaactaactaatttggtgaacccattaagtgaacttctttatactcatggtctagagtgcattgaacgctaaagggtttgctagagattgtcaaaatcaattctgtcttcttccaactggaccaaggcttctttgagttaacaaaactgagaaatctgagttgatttttcgtagtacctctttctattcttttggggtttttttgtttgttttttacttatcatggagattttccttaatttaacccaaaagatatacccatatgacatttgaactaatatgaaagaggtagtaggacaaagaatttgaagacagcctttcagagccccacaaagtacttgaagtttatcaataaacccctcccagtgtttcccaccatgttccacattccatctccatttttagccatgcagcttcaagtggcatctcctcctgtgaaacctacagtttggagataaattattgatgactaatgacttagaagaaccaaagaaaggatcctctagtggagacacagcatagaaatggtggtccagggtgagacagaactgcttccaatcccagtgccacctgtgtggttccagctgtgtgctgctcttcctctaatcttgtttactcgtctccaatacgggactaataacatatacatcagactattgtgagggttgaatgtaacaatattccaaattgttgcatgtgtccagtacttaacacagtgccaagaacaaagcatgtatcagtaagtatgaatggccttcccagcgcacacctccaaacagtggattctggccgatgacaggcaatggttccccgcggtcctacaggccacggtttaacttaccactagccaatcagtaagtttgcctcagaccacatcacgattcttttgcaagcctggagcttggtgaaaaacaagggggaaaataatccatgtccctaaggcagatgctgaaagatttacctcataacataattctctcaccagacttgtttcctgaatgtccatttaaattttaattctgcaaataaaataaaattggtaataatgaaagtgattaagatggtatttgtccagggaaccaatctccccacaagatacctaagaaagagatatatgtacagaaaatgaagcacagtaaaataccacttcattactatctggagattttccccaaacacagagaaagctctacagagctgagcttaaggcagaagaactctgttatttacttggtctaatgccaaaacaggccagagacccctctcacttacttctctttaatcccaaacccatgtctcaatttggtctaagaaagagccgaacacccaggaggcaccagggtagagaaaagcagccagccagagagtgacctccatgccaggggagtgtgtctgagctttgttttatttttcttatttgtctgtagttgtgtgattggtagaagagagtagatatgaagtctactgacacaggattggtcttcaggcatgtcttaccaagcataggggttccacaaataagagagcaatgatcagactttcttctaaaaggagcagccacaagctaccttaactctccaacttgcccataaatcttcacctacagttaggaagatttcaccattagctgtggcccataaaagatccttaagcttgaccaaccacagaggtccatctccttgaggaggaagtgaaaggggtatggacagaagctgtgagctttctgtcctccacaggcccccagctgtgtcttctacttcttgtacaagatagtctccaaatgatgttttctggcagacaatgccacagaactgatccttatctcactatggaaatgaaagatttcaaagaatttgttgcctgaaatatggtgccctaatcacatattaataaagctgctatccaggaagaaggcagatttcaaaagaaaggctgttagccttctcagggacctaaaaagtacatattgtagaacaatggtaaatagatcttggaatcaggtagactttaattcaagccccagctatgccagttattaacttatgtgacattgggaaaggctctcaaatttagttttgcaaaatcagaataatataggtagccaacaaatagggtttaatggaggtaataatgaaggtgattaagatgataaaattaaataatgaatataaagtgcttagcatgtaataaattttattgtatgatttcaaagcacatgctttacctacagtgctataaagctgcttgcaatagtcaaagctaatagaagctctagtcagagctaatagaagccttgtgtatataattatttaagaattctgtaaatatacataatagggtaggaatgagaaaatctttagaggaaatattcaaatatgcttggtttctagcaaatccagatagaccgttttggcaacaaccaagtcataattttaagtcttgttataggagctagaattttattcaaggggcaactgatttgattagataagatgctgtggactgcatgtttgcatcaacaaatgcacatgttgaaactctaacaatagaatggcattagaaggaggacctttgggaagtaatttggttttgatgaggatggagttcccacgatggggttagcatcctaataagaagagaaggagactagagccctcttctctcagccatgtgaagatacaacaagaacacctgcaaaccagtaagaaggccttcaccagacactggctctgctggcccagattttaatctttgatttctcagaactgtgagaaacaagtatgtgctgtttaagccactcagtctacagttgtttgtaacagcagcctgagcagacaaagacatagggttccttttattttcagaattcggtttagctgtaatcacctaccatcctgaaatgctgtttcctccttctgcccttgaaatataagctctgggactacagcttcatggacaaattctgaagaatttgtctctgctcctgtgggatgctaacctaatcaatcaaggaatgtttgctcaatggaatgaaacatcttaatgcagcttgccagccaatatctgcagagcacacctcatgggttctggctggcttggatttctgagactacttcatcctacccatcagactgtggactcagattcagccagaaggcctgattctagcgtcagttttgcctttgggatataaatgcatgccctacttcactgaacatgaaaccctgaatatttggccattactctggcaattgccctccctccctgtgccaattgccagtcaacccaactcccaggcagccttggcagttatgtctgctcggcctgctgtagcagccaatgacttagtaaaagtcagaacatagatctgctagctcccagtccaggatttccccttaactcatccatgtatatattaaacaactaggcttgcttttaaattctttttcatttagcctcttcttagaactgatcattttgagaatcctgacctgccaatattccataatctttctaaaagtgacacagcaaatacgacgcatgcacagtgctaactgcagctgatttcatttttccatcatctataaagcacataaggtaatttctaaaccagcagtaaaatctatttataaagaatgctgatttgttttctgcactttccaacacagagcttcaatttatttccttaccataaaaaaaccattactttttaaaacaatcatagttagtatattttataaatgttttaatttttgtaaagtccaacttgcaaattggagtgtaaatagctttcttaaaatggaaggaaccgtgttagacccagtatgctgactgatttcactgtgcttcaaagcagacgatttcacagtcattcggtaatgagtttttataaagcaattgatatcactaaaaatataattataataaataaaattataggaaaaaggaaatcttcattcagacaatgccaaattttttaactcattgctaaaagattatgtttgtacatgaaaaattttacacattctttctatgagataaacctgataacaccttgaaaacttaatagttatggaaaaggaactactgtgatattttttagagaatgtcgtgttcttgatgttcttgagtgagctgtctcatgttattagaagggaaacagcaccaccttgtggggaaacaacaccaccttgtggacaaacaaagaaagtgaatgaaattttagggccgggtgcttaatcccagcacttttgggagacctgggaggagggtaacttgagcccaagagttcaagaccagcctgggcaacacaatgacacacccatctttaccaaaaatttgaaaaattcgctgggcttggtggctcacacctcaggtcccagctacttggaaggctgaggtgggaggatcgcttaagccctggaggtcaaggctgcagtgagtgtgatcataccactgcattccagcctgggtgacacggcaagaccctagctcaaaaaaattatgtttatgtagcacttcctacaaggaatatagtatcttgtttgtatttaaatgacatcgggaccagcatggtggcttacagctgtaatctcagctcttcagaaggcagaaggcaggaggatcacttgaggccaggagttggaagaccagcctgggcagcataatgaaataataataatagtaataaaaagctaggcgtgctggcacacacctgcagacctagctactgtggaggctgagtggcaggatcgctttgagaccaggagtttgattgtactgcgtattgtgagctacgatcgagccactccagtccagacaacacggcaagacccagtctctaagcaaaataaagggacatcagagcattgcttacagagatttataaatgatcccaaaatgtcttcagggagataaattatctaaatatagctatatggactcttcctaaattccaaatttgggtggaaaaataaatgagatagaagacttcttgaaatgtatcaagactcagaaagacaaaacaaaaactttcattaggcagctaaagaggaaatcccagcgacaagaagccaaaggaaagggaaaagaaatgacaacaatgaccatactttctacacatccaacctcttctctaccaccactcagcaagacctcccacagccaatcactgccttctcttgtggacttaccctctactctgtgaacacatgagccagagaaccctgagaagtccctgggtcccttccaggggctctgcaaggtcaaaactcttttcataaaaatacacaggttttgttgaccttttccaatttcattctctcacaagtataattggagtttcccagaggctacctgacgtgggatgtcacaagaaattaaatgtagaagcagaaaggagaacgaagttttcttctattaaaccagacattaaagacatacttaaaaatataaaacaatgtcaatgttctcaccaactttactgtttaaaaatgataactttaaataaaaatgtgatttatgtaaacatataagtatatttttttaatttctcagctttaatgtttaatatgataaatatagatagatataatccaagtaaataaaagctctttggggtcctcaataacttttaaatgtaaagtggtcctgaaaccaaaaatttgaggacagatgctctaaagctcatactctctgatgtagcttccacccaggtcatttcttaaatacttgatcaatcatttcccatgtccctcaccctatccttgttgcaaaattccattttcctactctagccctccctgtcatgagaaagttcccaggttgtagacattatttactaaatatttcttaacagctttatgatgataacatgacatataaaaattgtgtaaatttaaggtaacttaatgttttgatattttatactttttgaaatgatcaccacaatcaagcaaattagcatatttattatctctacatatttaccattgtgtgtgttgacagtaattaatttatgatctagtcctttagcagaacacaagaatatgacacagtgttgttccatgttgtacattatatctccagaaattattataacttgaactttgtacaatttaaccaacatcaccccgtttcccctccctgagcccctggcaaccactgtcctattctctgtttttatgaatttgactgttgtagattcctcatgtaagtgagatcatgaagtatttttctctgtgtcttgcatttttgcttggtgcaatatcttccagctccatccatgttttcacaaatagaaggatttccttcttttttaaggtcggataatatttcattttatatatacatgccacattttctttacccattcatctgttcctctgccaaaggacatttaggttattttcatattttggtcattgtgtgtcatgctgcaatgaacaggggatgacagacacctctctaagactcttatgtcaatttcattggacatatatccagaagtgaaattattggattgtggcagttcttttttttatttttgaaatggggtctcactctgtcatccagggtaaagtccagtggcaagatcatagctcactgcagccttgaactcctgggctcaagggatcctcctacctcagcctcccaagtagctgggactacaggtgtacaacaccatgtctggctaattttaaattttttcagagatggggtcttgctatgttacccaggctggtctggagctcctggactcctgccttagcttccccaaatcctggggttacaggtgtgagccaccacaccaggccagtgctagtttcaattttctttggaggaacctcaatactgttttctgtgttttactaatttgcattcccatcaatagtgtataagggtttccttttctccacattctcaccaacacttatctttggcctttttgataatagccattttgacaggtgtgacctgatatctcattgtggttttgatttgcatttctctgaagtttagagatgttgagcacattttcatatacctgttagccatttgaattccttcttttgagatatatttatttagattctttgccttaaaataaaattaggttatttgtaattttggaattgatgtgtatgtgtccttattttttgaactccttataagagatatggtttacaaactttttccccatttcataggttgccttatcatttcattagttgttttctttgctgtgcagaagctttttagtttgatgtaattcatttacctattttgcctttgttgcctgtgcttttggcatcatatctaaacaaattattgccaagaccaatgtcaagaatgttttctcctgtcttcttctaggagttttatggtttcaggtattgcatttaaatgtttaatccattttgagttaatttttatgtatgatgtgagctagggatccgatttcattgttttgcatgtggacatccagctttcctaacaccatttgttcaagagcatatcctccccctattgtgtctccttgtcaccctccagggtgatcaattgctgcaaatgtgtgggttatacctaggttctctattttgttccactggtttatgtgtctgtttttatgccagtaccacagtgttttcctttctacagctttgtaatttaatttgaagtcaggaagtgtgatacctgtagctttgttcttgctcaaaattgctttggctactcagggttttttgtgattctatatgaattttaggattattttttctatttctgcgagagacaccattgggattttgatatggattacattaaatgtgtagattgctttgagtaatatggacactttaataatacagtactcactctttcaatccatgggttgtctttcaatttacttcaaatttccatcatcaatcttttgtaatttgtagtgtttaagtctttcacttctttggttagttaattccaaagtagtttatttgatattgttttttaaatttccctttcagacaattcattgttagtgtttagaaatagcaatgatttttgtatgtctattgtatatcctacaactttaataaatttattatatagtcagtccttcatattcatgggttctgcaaccatgaactcaaccaaccatgaaccaaacttgtacatattttccatctgtggtggtttgaatccacagatgtggacccatggatacacagggccaactgtacatgattttacatgagggagttgatcatcacagattttgttatctgagggggtcctgaaacaaatccctggcagatatgaaagactgactgtattatttctaaccaattatttctaaccattttctgtggagtctttagagttttcaatgtataataatcatgtcttctgttaacagagataactacatctttcctttcaattttgatgccttttatttctcttgcctgatttctctggctaggacttccagtactatgttgaataggagtggtgagagtaggcatccttgtcttgttccagatattaaagaaaaagctttcatttttccccattgattattatattagatacaggtttttcatatacagcctttatagtgttgaggtaagtttcttctatacctattttgttgagagttttatcatgaaagtatgttgaattttgtcaaatgtgttttctgcatctattggaatgttatttttgtctttcattctgttaatgtggtatatcacattattaatttttacacattgaaccatccttgcatcccatagataaattccaattagtagtttattgagaatttttgcatctatattcattaaggatactggtctgtaattattttttcttgtgttgttttcatctagcttttaagtcatggtaacattggcctcatgaaatgagtttgggagtattctctcttctattttttctaaagagcttaagaagttttggtgttagttcttctttgactgtttggtagaagttgcccatgaaagcatctgcacctgggcttttctttgttgggaaattttttattactgattgaatctctttgcttgcttttggtctgttctatttcttttttgttccaacttggtagattgcatctttctaagaatttatccatttcttctaggttatccaatttattggcatataattgcttaattgtcctttataatcatttgtattcctgtacatttgttataatgtctccattttcatttctgattatatttacttgagtctctctttttttcttaatgtagctaggggtttgttatttttgtttttatttccaaaaatacaactctagctttgttgatttttatattgttttttattttaaagttattttatttatattctaatctttattatttacttcattatgctaactttgggcttagttagttcttctttttctaactgtttatttgtaaagttaggttgttcaattgagatctttcttattttttaatgtaggtgtttatcactataacatttccctcttagcacttcttttgctgcatcctgtaagttttgttgagttgtatgttcatttttgtttgtctcaagatacttttaaaattcccttttgatttctccttttacccaatggttgttcaagagtgtgttgtttagtttctgcatttttgtaaatgtttctgttttctttgttattgatttctaattttattccattgtggtctgagaagatacttggcattatatcaaacttcttaaatttgtaggatgccttgtgacctaagatttgatctatctcagagaatgttctgtgtgcacttgagaagaatgtatattctgatgctgttggatggaaagttctgtatatgtcagtgtttaatgtaccatgttgttcaagtcagctgtttcctcttttttttcttttttttcctgcctagatgttctatccattattgcatttggggtactgaagttagctactattcttttattgttactgatttctccccttagctttgttgatattaactttatatatttaggtgttctaatgttgggtggatacataatcttcctgttgaagcgaacttttatcattacataatgaccttcttagtctctagtgacagtttttgatttcaagtctattttttctgatctaagtatagatacccttgctcctttttggttaccatttgtgtagagtgtctgttcccatcccttcactttgagcctctatgtatctttatatctaaagtgactcccttataaatatgtactgatgagtatcttttatgcattgtgccactctatgtcttttaattagatagtttaatcctttcacatttaaagtcattgttgataggtaaggagtaacttgcattttgttaattgtttttcatatgttttgcagttcttttttttttcctctcttgctgtcttcttatgtttggttatttcttgtagtggtttggtttcttttcttcttcttcacattttgtgtatctcctataagtttttaatttgtggttgcaaattaacatcttctattaaaagctgtcttaatgttatcagcttttttggaatcattttctttctcttccctcttcagacatatttgcaaatagtctgtttttcaagacacgagtaaatagggctctggttagaaatttatcaatatggaaaaaaaaagatcctctgagtcttttgataagttagaaaataatgatagactgtggcagaatgtcatgtatttcaagtatttcatctgtgttactctgcaatatattttctgtgtgcatttgtcaatgttatatatttataaggtaaatccataaagcatacattctagaatctcctaacttaggtccttaagagatatgctccttataaccttcttggcactcttgaagtgttaaatatttccattgaagaaggttgcatatggtttctgagatgaagtctagacaggttacgattattttttgttccttttgcccacacagcacccactgtcccctccctttgttattagcctttatctgataccctagatgaagccaccttctgtccttcagttttggcgtgggggctgatttcacccccagtttcaggaataagcacaggacagctactaacaagtatgttgttcactcaaggaagaaacccagctaagggagaaaggggggctgaaatccggcctacatgctcttctccaagccacatgccccgatacagggctgcatctaactgcagaaagggtagccattttctaatacttgcaaaggcactgtgtggacagtgcaaactctgtatgagctcatgacacaggcctggccaataaatatacttctaatcctggcacagatcagactagagacggacatgaaatccaagcgtcacacccaaagtcaatctctagtctcttattgagactattagaagtgtttctgtgtttgctttattctggggctgtggaactaaggaagtgtaaactggaggagtgatgatggccacattgcagaacaaagggaaaacttgtctgagaataaagtcaatggggaagaaaaaagcaagaaagctgagaagagctaagtcctgagtccctacgttcagccattctgaagctacaccctggatttttccattatacgagtccacaaattaatattttttttttggcttagaccagtttgagtttgaattctattatttataaccaaaggagtcctaccatattatcatagctggattttcataaacacggtatatgttgatcaacaaacttcctagatgtttcaagttcactccgaagagtgaggggaaaaagaaaagaagggaagaaaatggttacttatcatccacagtagtcaaggaagctacagaagcatcaagcaaaagcagcggaagttagctttgtactcccacaaaccctgctctgaagtactccgcctagtggcccacagcagaagctgcatttctaaaatctttaaaaagatagaacaggaatcaccacttaccctgggaaccctaataggtgagcaggccacatgggaatatgtcccattggtttgaggtagataagtccattttcaaagcggtagtaattccggaaacaagaacatattaattttactttgatcacacaatgcctagttatattaaaagtaaagagacattcaataaataccttttatggaaataaaaacagacaatttaggagagaattaactatcaatgcgttattttcaaaggtaaagaaaaaagaaattattctgaatgcacaaaactattttatcaaatatcatggtaaattatcattatatactaggtcacttaataaatttccagagatgattgtaaacagtttccacaatagattttgtttcaccccaggaagtttcacaaaaagttagttacttatctccattgttactagtgccaactaatcctatcattctgagtcaaattaaaaataacatccacacttttctccagtgagatcacaggagatgcctaagtggagtgtgttttaatgtgaggggataattggtttatatttttcactgacaataacaaataaattctagacaacttaagcaaaataggaattcaatgaaaggatactgaatagttcacaaaatcactgaagatgctggagaagcaaggtaagagctgagggaaacttggcacagccaagttcatcctacggaagcagatcttgggatgccacaactaggatgttgccatttgacactcatcaccatgtagctgggctctgctgaacttaggcacttcctgccacattcctggacctgcatctctgctcagttgctcagaatcatctctgattctttcaggtcttttgcatcatttcgtcgggttccaagttctaataaagagacatccattggctgggcctagatatgtgcccacacttgagtggccaagaaactggaaaaaggatcatgcactccctttcagcttttgtaatggaaggtggggcctgtcctcatactttgcttggggttcaaaaaactaggaagggtgttttgttgaaatgaaacccaaaactatagctatccatttatagcaccttattagtacaggaaaaaaccatgagacaaaatgtataaaagtgcatgggaggtctaaacatatgagggggtttctgaggagaggaagatcatacttgattggtgctgtggtttcactgtgcctcctccgagattcagcgttgacaatgtgatagtgttgaggtggagcctacaggaagtgattaggccatcaggactcctacctcaggaatgggtttaggagccctcatgaaagggcttcatggagggagttcattcctcttgccctcccaccttccaccatgtgaggacacagtgttccttgactctggaggatgcagcataaagacaccatcttgaaaggagagaacagcccttaccaaacatcagacctgccagcaccttgatcttggacttcctagtctccagaactgtgagagataaatgtctggttttcataaattgcctagtctctgttatttcactataagagcataaattgactaagacaactggggattagaaaaagtaatatgaagcggcatttgagaagggcttgatagataagatctctacaaatagaaatagagagatggtttcacatcacccaggtgaagggaataacatagccatgttcagtctgaatgcaaaatggagatggtaaaaaaagtacataggattccaccaccagtgggaggacagaattgcaatgtggcagcaatctgtaaattaaaatatttatcactcattcccatttatttagagtctaatgtgttctaggctctgaaattaagcaaagaaaatctagatatgagtaagtccaagactttgcctttgtgacagtcaaaataatgaccccataaagatgttctagtccctggaatctgtgaccatattactttacatggggcaaaatggattctgtagatgtgattaatccttgagttagggggattatccttgattatcttgggggccaatctaattgcatgtgtctataaaatcagagaatctttcctagctgcagtcagaaggtgacatgaccacagaatataaaatcagagaatctttcctagctgcagtcagaaggtgacatgaccacagaacaatggtcacagatatcccacattactggctttgaagatagagggatggtcctatgatccaaggaatggggacagcatctacaagttggaaaaggaaatggattctctctagagcctccagaaagcaatacagccctgacaataccttgagttaagcccagtaagaccacggtcagaggtttgccctacagaactatagggtcgtaagtctttgatttaagccacaaagttgtggtaatttgttatggcagcaatagaaaattgattttaaggagtttattgtttggaagataggcagaccagaaaatccaaattataatataattcgattaaaacctatggagatttgggctaggtgttttagaaaagaactgagtattaacaagactaacagaagaaattgttctaaaatttacacactaagtacatcacatttttctaatgatcacattgatagagcaacttagaatccatgctttcaacaaaccaacaggcttatatacatatatatataattttatatatatataattttatatatatataattttatatatataatatataatatatggaatagccccacgggcatgggcagccctgggccacagggcagcactgtactagcagcctacaccccaccttacctgcctaccctgagctgacttgtctgctaaatgctaaataaacctgtcaacctgtcgggtttaactcagaagggcctggatgcaacaagcctgagggctgtgactggggtaagagagagcacagacggagctcctcctccttccaccactgcccaccagctgaaaaccaccaactgaagtttgctaagattctcagcctacaccttgttcccaacaaaactcatgcaatactttggcccccactacaatctcttgaataaaatattctacggatctgctttttgagctgcaagttatcttactaaattccaagaagctcatgtaagagaaaaccaccacataatataagattttcaatgtgatcatcattgctacttttaactagaaaatatccagtaaatgtattgtgaactgctttgtgactatggtgatttatttagtctttctgatccttggtttgattatctcaaatatataagtatcaccaattttataaagttgctctaaaaattaaatgagagaaaaataattctccttctccacatactgaacacttacaaaattataggcattgtgtccaggtttttacatacttacctgatggaagtctcctaacaaccctctcttttaaattacaagcattttgccacgatttttacacatgtatgttatggaggcctcgcaacaatcacatcttttataggtgagcaaactgaggctcagacgagttaaaaacacattcaccatcaaatcataatgagggacggaactgggattcaaatccagttctctctgatgccaaaaatggtgcaatttaacaaggaccaagttacacccagaacatggagggatcataacatgtggattcccttttctgccccctcatgtgggaatttcaatagctttcactgcctcagagcaatcctaaactccctcccaggtgccttgcaatggcccccttattcgtgggggtgattaggaatctgcatttttggaccacgagcatccataaacagttgtgttgatcaagaaataaaattttctaggccataggttactgtgaattgtctagcttctctgcaaaaaataaaggggctattccatgtaaaaaaatcacaggatccactgaatttgtgcagaaaaacttagaactataccgcaggaggatcttactgacagctgtgcctgaagaccagcccaaccacacaaagcaatagcacctccaatggccaggtgtggtggttcttgcctgtcatcccaacagtgtgggaggccaaggtgggtgaatcacttaaggccaggggtttgagaccagcttgggcaacacagtgagaccttgtccctacaaaaaaatcattttttattattagaatcaagaagagtacctctaaccccctgtcattgctttagggtagagagctctggtctagaactcaagatatgaaattgtgaatcccagtgtagctacttaagcttaaattcaagagctgccagacatttcctctacagcaacgaaatctgtagcatccattttgtattttgaaaacttagtttttggccagcctctgggaacaaaaggacccagaattgggcatttgggtagggagggaaaaagaaaccggctggatgcaaaaggggaagacgaaggggtggggacgccaggcagagccagtcctcatgcttggggcctggacctaggaaaggaactaggtgaagaagggaggagccccaggctgtggatgtctctgggggaaccttggttcagcaatggccagaggaggtcctgaggccaagcggtatctgtcgcctccttacctttgggtgtcttctggtcgccaatgtgctgcaggtcatggctccggaatcaaattgggctcaaacggggcaagctccaacacagtggagcctggcgctactcccacctccaccttgcggatctcagagctgcaggatggctctgcccaccgcaccctgagctggccccgcttggggctggcattgggggacagtgtgttctgggcgtctctgctcctctctgctggtgcctgtgcctctgctggccgcccactcatagatgtcagagccacaggacggccccgcagaatccctgcgctgaccctgccgggggctggctttggtgcacatgcaactcgtcatcgtggtccccatggggcacctctgctcttctcgaggcagcttgggccttcgcttgcccccacgtctgcagagctgagcacctgccacctctccccaggaaaggcaaccaaatgccaccaacttaaggcacccactgaaggcactaactgaaggccaccaacggaaggccggttgccctgccagccagatcgcgtactgcttaggaagaaccaatcaggccttgagttccctccacgtgctgcccttccatttgtgatgtggaagtccaggcactggctcacaaaaccgcgccccccagtgatgccgccccacctttcatttattggtagctggtagcaactttcaggtttcctcactgtgaattatgaatatgaattatgattaaattactgtatgctaatgtacctcatgcactatctgacagtcaaagtcccctcttcccccatggcctctgagttttttggaaactagaaagaagacacatttctgcaggtgctttcagaaaaaaacattgccacgacctaatgttactctgtgacgtcaagtcatatttcatatatcatacatattcatatttatattcataattcaaaatgcacatattcaatcaaattaacaggactaacaaaggaaattttctaaaacttatacactaagtacattatatttttctaatgatcactttaatagagcaacttagaatctatggtttgaacaaatgaagaggcttatgcaagagaaaaccaccacctaacacaagattttcaatgtgatcatcattgctacttttcactagcaattgtccagtcaatatattgtgaactgctttgtgactatggtgatttatttaaacttactgatcctttatctcaaaaatatgaataataccaattttataaacttgttctaaaaattaaatgagagaaaaataatcctccttctctatatattgaaaacctacaaaattaataacattgtgtccagatttttacacacttaccttattgaagcctcatcacaaccccgtctattaaattataggcattattcccagatttttatacacttaccttatgcaagcctcgtaacaatcccatcttttatagatgagcaaactgaggctcagacgagttaaaaacacattgaccatcaaatcatagtgagtgatggaactgggattcaaatccagttctctctgacaccaaaggtggtgcaatgtaatgaagaccaagttatatccagcacatggagggaccaaaacatgtgaattccctttctctaccctcttacgtgtgaatttcaatggctttcactgcctcagaaccatcccaaactccctcccaggttgccttgcagtggatcctttcttcttggggatgattaggaatccgcatttttggaccacaggcatctataaagagttgtgttgatcaagaaataaaattgtctaggccataagttactgtgaattgtctagcttctctgcaataaataaaggggctattctctttattttttattattccactattcacaatagcctagaatcaacctaagtgtccaagaagactcggtttaaccctggggattactaatgttttcattgtggtcaatgtggtagattatattaccattctcccattatctggtcttcctactgcagtggccctatctcctagaagattatacatttctgtcctattgaagtaagggtcagatttagacatgtgaccggtttggccagtgaaatgtaggtagaagtggcatgtgtaacttgttagcagaaaatttcctttttcaaggatctgggagccatccctttcaaatgtaatcctccagaaagataataccttatttcccagtctctatgagagagtaagagcctaatcttgctccaagttgtaaaaattaccttatattataaagataaaagaaagtttatttttcctttgagaaaagacagttagcaaagacaggtggcctatgatcacccccttactctcgctttcaaaaactccactgccctttgtatcaggggagctgagttcagactaggttctggcctctctcccctgttgaataatatcttccttacttatttaactttttccagtgcaattttttctttgactctttcctccctctctgaaacttgcattgaaattttagtaggatacaaggcaggcaatctcgacccttgaatatataaaagaaccctttaggattaaaaaacccatgttctcttccataagttatttcttcagactattgccttattaaaagtttctagttcttatttttgcattgaaaaggagaatgatgatttttaaataagttcctactcacttttaatttctactatcacaattttattgcttttcatggcaatagatttctctggttcaacaagaaggccagaacaaggaagtacagaaacatctcaatatatcttaaaaagttatttaacatggacagtgtcatttaatatctttaacatccctatcaaatggatgctattattatcccccttttacaggatattaaaacttacatactgtaaataaccagctgaaagtcatatagcatggaaaatacaataagcatacaaagaagcaatggcattagaagtggaggagagttaaggattaaaaggctaaacttagtttggttaagaaaaaagaaaactaggaggtggcaaactcttgttggaaaggggaaggatttgggcagagcaaggtagtggagtcgatctctccagtaatcttacccctacggacacatctatatgaacaactatccacatataaaattacctttacaagagctaacgaaccctgaatacatgagtcagtctatgaagcccctttggactgcaaagagtagaaccatgcttggacagtaagggaaccagtactctgtgactgtgatactcctcccccaggccataatggtattatatgcagaaagtcctccttacagttcttacactgaataaagtgagcagaagttgaatatttttttccaccatactgagtcccttcacagtagactcctgcatcagcccacaagcagcaccatgagtgtcaacagagctgaaccgcccgaggcatgctagggacatagagaaggggttgggttagcaatactcattatatgaaacttagcagtggctagccattcctaccagaggaaacactacaccagagaggttgtttatgggcaccatgctgtgggaaacatgatacacagactgtccagatttgatagcctgacttgttctcccccacagccaggagcctttctgtggatcacccatgggcccattcagttacattgcatcagtggtgaagccccattgtgagacttatgtctaacctttgctttgggcacctcctaatgctaaaatggaatataatggaaatccacaccgaatttctaaacaagcccactgagaaacagtcaaaaacaaacccagactgagaagactgaaataaatatttaattcatcaatgtgtagacagagatatacatctacaaaaaataagaatagcctaggaaaaactgcctcaccaaatggagaaaataaggtgtcagcaactgaacctaaagacatgcaaatgaatgatgtggcagacaaaaaaaattcaaatagctgattttaaaaaaaaaatcggtgaacttcaacaaagtacagagaaacaatatggaaatttataagaaattcaacaaagaatttaaaataatgggaaaaaatcaagtggaaatcctggagttggaaagttcagtaaacaaattgaaaaatgcactagagggcatcaaaagcagaactgatcaagtagaagaaaaaaacagtgagctcaaagacaggctctttgaaaatacactgtcaagagtagaaaagagaaaaaaatgagaagaaacaaagaaaacttatgagatccatgggacaccatcaaaaaaaaaaaatctacagtgttaaagtggaactgagaatgaaaaagagttagaaaattattcagagaaataacagaaaactttttaaacttagagaaacattaagatgtttaggatggccaaagcgcactaatctgatttaatctgaataagacaaccacaagatatattataattgaactttcaaaggtcaaaaacaaagagtaggtcctgaaagcactaagaaaaaggaagcatataatacataatgtgcctggcagcagacttctcagcagaagcaatgtgggccaggagagagtaggataatagaatcaagtgctgaagaaaaaaactgtcaaccatgaatgtagtatccagaacagctctcatttgaaatgaaggagagattaaaacgttctaagacaaacaaaagatgaaggaattcattgtaaccatacctgccttaaaaaaaatgttaaagaaccgtcttcaaagtgaaagaaaagggcactaatatgtaatgcaaaaaattggaaggtataaatccacaggtaaaaataaatattcagacaaattcagaatgctctaatatagtaataattgaatgtaaaccacttacatatttttagtaagaaggttaaaatacaaaacaaaaataataacaactacaataatttgttaagggataagtgatataaaagatgtaaattcagacatcaaaaatgcaaaatgtgggggagtgattgagttaaagagcagagtgattgtttttccccatttcttattatcaaaattaagttgttatccattcaaattacctgttgaaaccataaaatattcttcacatgcctcatagaaaccaaaaggcaaaaatatttaatagatacactaaaaataaaagaacaagaaacaaaaacacacagaaaaaatcacttaactacaaaggaagacaataaaggaacaaaaaggtacaaaaattctaaaagacaacaagaaaaccacgtacggcagtacaagtccttatctatcaataattaccttgaatgtaaatagattaaattatccagtaagaagacagagaatgggtaaatggattaaaaacaagacctaactatattctttctacaagagactcccatcacctttaaatacacgcataaattgaaagtgatcagatggaaaaatatattttacgacaatggaaatcaaaagaatgcaggagtaggtatatttatatcaaataaaatatacttcaagtaaaaaaactataaacacagacaaacaaggccattatgtaataataaaggggtcagtacaacaagagaatacaataattgtaaatacataatgcactcaacattggagaacctaaatatataaagcaaacattaatagttctaaaaggagagacaaaaaactgtgcaataatagtaaaaaaccttgacatcccattttcagtaatgaacagatcattgagagagaatgtcaacaaggaaacatttaaactgcactctaggtcaaaagaatttaacagttatttacataacatttcatccaacaattgaataattcagtcttttcatctgcacatggaatattgtccatgatagatatgttagaccacaaaacaagtcttagctaatcaaaaaatcaaatcatatcacatattttttctgaccatatggaataaagctagaaataaacaataagagaaacttcagaaattgtgcaaatacatataaattaaacaatatatccctaaacaaccaacgggtcaatgaaaaaaaaaatttttttaaatgtcttaagacaaataaaaatgaaatcagaacatatgaaaacttatgagatacagcaaaacagtccttagagggaagtttatagcaatacatttctacatcaataaagaagaaagataatgaataaaccctctaattatgtatttcaaggaactataaaatcaagaacaaactaagacccaaattagcaaaagaatataaagatcagagcacaaatatacaaaatgaagacaaaaaatacaaatgattaattaaagaatcttttttgaaaaggtaaaattgacaaacgttttgtcagactaagaaaaaaagagaaaattcacataaagtcagaaatgaaaaaggatatgctatgatggacactacagaaatacaaggaatcatgagtaagtactacaaacaattatacaccaataaattgaaaaacttagaagaaatacatatgctctggacacatataacctatcaaaattgaagatagaagaaatggaaaatgtgaacacaccaatgacaaataatgagattgaaggagtgatttagtctgtcagtcaaggaaaatccaaaagacttcacacagtagctcccacctgtaatctcacattttaggatcccaaggcaggagaatcactagaggccaggagttcaagattagcctgggcaacacaacgggactccatctctaaaaataaaaataaaaattccccaggtatagtggtgtgtacttatactcaggaggctgaggcaggaggatcacttaagaccaggagtttgaggctgcagtcagctacgactgcaccactgtatgccagcctcagtgatagagtgagactctgtctctaaaaaaatagaagaagaaagaaaagttcatgacttgatggttttcactgacaaattctacaaaatattttaaaaacttatacagattatttacaaactatttcaaaaaaatgaaaaggagggaactcttgcaaactcattctatgaagacagcattacctgaatccaaaatgagacaagaacagcaaataaaactccaggccaatatcattgataaacatacatgcaaacattcaaaaccagcagtgctagcaatgataattcaaaagcacattaaaaagattattcaccataatcaagtggtatttacccggggaggtaaggatggtctaacacatgtaaatcaataactgtgatacatcacattaaacaatgaaggataaaaaacatataatcatttcaatagatgcagaaaaagcatatgacaaaattagacatccttttatgatcaaatcttttgacaaattagttataaaagaacataataaaataaagaccatatgtgataacccacaggcaacattatactgaatggtgaaaagttgaaagctttgcctctaggatctggaacaagacaaggatgttcactttaatcacttttttcaacatagtactggaagtcctagtcagaacaattaggtaagagaaagaaataaaaggcatccaaattggaaaaaaaagtctaattgtccctctttgcagatgacatgatcatatatgtaaaaaaccctaaataccccactgagaatcagaaatagtaaatgaatacaataaggtttcaagatacaaaagcaacataaaaaatcagtaacatctctattcaccaatagcagactatctgaaaaaggaatcaagaaagtaatcccatttaaaatagctattaaaaaaaacaaaatacctacaagcaaattaagccacggaaagatgaaaattattaaacattgataaaagcaattgaaaaaaattaaaataaatagaaagataccccatattcatggactagaagaattaatattgttgaaatgaccacactactcaaatcaatctatagatccaatataatctctatcaaatttccaatttcattcttcacagatattaaaaaagatcttaaaatccatgtgaaactacaaaacaccccaaatagccaaataaatcttaagcaaaaagagcaatgctagaggtattacactatctaatttcaaaatgtattgcaaagctatcctaactaaaacgcatggtattggcataaaaacagggacacagaccagtggaacaaaaatagagagcccaggcataaatccacacgtttacatgcaacttatttttgacaaagatgcaaacattcaatggggaaaagacagtattttcaacaaatggtgctgggaaaagtggatatccccatacaaaagaatgaaagtagacccctatctctcatcatatccaaaaaccaactcaaaataaattaaatatttaaatgtaagaccccaaactatgaaactagtagaagaaaacataggtgaaatgttatatgtcattggtctgggcaaggactttttagaaaagacatcgaaagacatgcacaacaaaagcaaaaataaacaaatgggattacaccaaataaaaacttctgcactgcataggaaacaatcacaagagtaagcagacaacctacaaaatgggagaaaatatctgcaaactattcacttgataaggggttaatatcccaaatttatagaaaactcaaacaactcaatagcaaaaatacaaataattggattagaaaatagtcaagagagctgaatagacatttctccaaataagacataaaaatcaccaacaggtatatgaaaaaaatgctcaccatcactaataatcagagaaatgcaagtcaaacctgtcaggcctctgggcccaagctaagccatcatatcccctgtgacctgcacgtacacatccagatggttggttcctgccttaactgatgacattccaccacaaaagaagtgaaaatggcctgttcctaccttaactgatgacaatatcttgtgaaattccttctcctggctcaaaagctcccctactgagcaccttgtgatccccactcctgcccaccagagaacaacccccctttttcctttacctacccaaatcctataaaatggccccacccctatcttctttcactggctctcttttcggactcagcccacctgtacccaggtgaaataaacagctttattgctcacacaaagcctgtttgatggtctcttcacatggacgcgagtgaaatttggtaccgtgactcagatcgggggacctcccttaggagatcaatcccctgtcctcctgttctttgctccgtgagaaagatccacctataacctcaggtcctcagaccaaccagcccaagaaacatctcaccaatttcaaatccggtaagtagcctctttttactctcttctccaacctccctcactatccctcaacctctttctcctttcaatcttggtgccacacttcaatctctctcttctcttaatttcaattcatttcattttctggtagagacaaaggagacacgttttatccatggacccaaaaccctggtgctggtcacagactagggaaggcagccttccattggtgtttaatcattgcagggacgcctctctgattattcacccaggtttcagaggtgtcagaccacacagggatgcctgccttggtctttcacccttagtggcaagtcccacttttctgggggaggggcaagaaccccaatcccttctctccatgtctctaccccttctccacttttctgggggaggggaaagaacccctcaaccccttctccttcacccttaatggcaagttctgcttttctggaggaggggcaggaaccccaacctcttatctctgtgccccgatcccttatttccgtgccccgacctcttatctctgtgccccagctccttatttccacgccccaaccccttctctgcttttctggagggcaagaaccccccaccccttctccgtgtctctactctcttttctctaggcttgcctccttcactatgggaaagcttccaccttccattcctccttctcccttagcctgtgttcttgagaacttaaaacctcttcaactctcacctgacctaaaatctaagcatcttgcatcttattttcttctgcaatgccacttgacaccaatacaaactcaacagtagttccaaatagctggaaaacggcactttcaatttttccatcctacaagatctaaataattcttgtcataaaatagacaaacggtctgaggtgcctgatgtccaggcattcttttacacatcagtccctccctagtctctgttcccaatgtaactcatcccaaatcttccttctttccctcccacctgtcccctcagtcccaaccccaagcattgctgagtctttctaatcttccttttctacagacccatctgacctctcccctcctcaccaggctgagctaggtcccaattcttcctcagcctctgctcctccaccctataatccttttatcacctcgcctcctcacacccggtctggctttcagtttcattctgtgactagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatggctcgtttggcagcaaccctgagatgttttacagccctaagagcctaaaagatcaaaaggccgtcttattctcaacatacattttattacccaatctgctcccgacattaaataaaactcctaaaatgaaattctggccctgaaaccccacaacaggacttaattaacctcaccttcaaggtgtacaataatagagtagaggcagccaagtagcaacatatttctgagttgcaattctttccctccactgtgagacaaaccccagccacatctccagcacacaagaacttccaaatgcctaaaccgcagtggccatgcattcctacagaaccgcccccactaggagcttgctacaagtgccagaaatctggccaccaggccaagaaatgcccacagccctaagccatgtcctcctaagccatgtcccatctgtgcaggaccccattggaaattggactgtccaactcacctggcagccactcccagagcccctggaactctggctcaaggctgtctgactgactccttcccagatcttcttggcttagcggctgaagactgacactgcctgatcacctcggaagccccacagaccatcacagatgctgagctttaggtaactctcacagtggaaggtaagtccatccccttcttaatcaatatggaggctacccactccacattaccttcttttcaagggcctgtttcccttgcctccataactgttgtaagtattgacagccaggcttctaaacctcttaaaactccccaactctggtgccaatttagacaatactcttttaagcactcctttttagttatccccacctgcccagttctcttattaggccgagacactttaactaaattatctgcttccctgactattcctggactacagctacatctcatttctgcccttcttcccaatccaaagcctcctttgcatcctcctcttgtatcccccgaccttaacccacaagtataagatacctctactcgctccttggcaactcatcatgcaccccttaccatctcattaaaacctaatcacccttacccctctcaatgccaatatcccatcccacagcatgctttgaaaggattaaagcctgttatcactcgcctgctacagcatggccttttaaagcctataaactctccttacaattcccccattttacctgtcctaaagccagacaagccttacaagttagttcaggatctatgccttatcaaccaaattgttttgcctatgaaccccatggtgccaaacccatatactctcctatcctcaatacctccctccacaatccattagtctgttctggatctcaaacatgctttctttactattccttttcacccttcatcccagccttcttcactttcacttggactgaccctgacacccatcaggctcagcaaattacctaggctgtactgctgtaaagcttcacagacagcctccattacttcagtcaagcccacatttcttccttatccgttacccatctcagcataattctcataaaaacacatgtgctatccctgccaatcatgtctgaccaatctctcaaaccccaaacccttctacaaaacaacaactcctttccttcctgggcatggttagatactttcgcctttagatacctggttttgccatcctaacaaaaccattacataaactcacaaaaggaaacctacatgaccccatagatcctaaatcctttccccactcctctttctgttccttgaagacagctttagagactgcccccactctagctctccctgactcatcccaacccttttcattacacacagctgaagtgcagggctgtgcagtcagaattcttacacaaggactgggatcgcgtcctgtagcctttttgtccaaacaacttgaccttactgttttagactggccatcatgtctccatgcagcggctgctgccaccctaatacttttagaggcccttaaaatcacaaactatgctcaactcactctctacagctctcataatttccaagatctattttcttcctcacacctgacgcatatactttctgcttcccagctccttcagctgtactcactctttgttgagtctcccacaattaccatttttcctggcccaacttcaatctggcctcccacattatttctgataccacacctgacccccatgactgcatctctctgatccacctgacattcactccatttccccacatttccttcttccctgtttctcaccctgatcacacttggtttattgatggcagttccaccaggcctaatcaccacacaccagcaaaggcaggctatgctatagtacaagccactaacccgcctcttagaacctctcatttcctttccatcgtggaaatctatcctcaaggaaataacttctcagtgttccatctgctattctactactcctcagggattattcaggccctctcccttccctacacatcaagttcaaggatttgctcctgcccaggacaggcaaatttgctattctactacttctcagggattattcaggccccctcccttccctacacatcaagcttaaggatttgaccccacccaggactggcaaattagctttactcaacatgccccgagtcaggaaactaaaatacctcttggtctaggtaagacactttcactagataggtaaaggccttttccacagggtcgaagaaggccaccacggtcatttcctcccttctgtcagacataattccttggtttggcttcccacctctatacagtctgatagcagaccggcctttattagtcaaatcagccaagcattttttcaggctcttagtattcagtgaaacctttatatcccttacagtcctcagtcttcaggaaaagtagaacagactaatagtcttttaaaaacacacctcaccaagctcagccactaacttaaaaaggactggacaatacttttaccactttcccttctcagaattcaggcctgtcctcagaatactacaaggtatagcccatttgagctcctgtatagacgctcctttttattaggccccagtctcattccagacaccagatcaacttggactatgccccaaaaaacttgtcatccctactatcttctgtctactcatactcctattcaccattctcaactactcatacatgccctgctcttgtttacactgccagtttacactgtttctccaagccatcacagctgatatctcctggtgctaccctcaaaccgtcactcttaactcttaaagtaaataaaaaatctttgctggcaaagctatgctgaacctccttaggcactctctaattagatgtcctaggtcctcccaattgttagtcctttaatacctgtttttctccttgtcttattccgtttagtttttcaattcatacaaaactgtatccaggccatcgccaataattctaaatgacaaatgtttcctctaacaaccccacaatatcaccccttaccacaaaatcttccttcagcttaatctctcccactctaagttcccacgccgcccctaatcccgctcgaagcagccctgagaaacatcacccattatctctccataccacccctaaaaaattttcactgtcccaacactttaccactaattcattttatttttcttattaatataagaagacaggaatgtcaggcctctgagcccaagctaaggcatcatatcccctgtgacctgcacgtacacatccagatggccggttcctgacttaactgatgacattccaccataaaagaagtgaaaatgccctgttcgtaccttaactgatgacattatcttgtgaaattccttttcctcgctcatcctggctcaaaagctcccctactgagcaccttgtgacccccactcctgcccgccagagaacaaccccccttttgcctttacctacccaaatcctataaaatggccccaccccatctcccttcactgactcttttcggactcagcccacctgcacccaggtgaaataaacagctttattgctcacacaaagcctgtttagtttagtggtctcttcacacagatgcaagtgaaaaaacccacagtgagatatcatctcaccctgcttagaatgccttttatgaaaaagccaaaaaataacaaatgctggcaaggatgtgaagaaaggggaatgttcatacactgttggtggaaatgtaaattagagcaattgttatggaaaacaatataacttccaaaaacattaaaaatagacttaccacataatccagcaatccccctactgggtgtatattcaaagaaaattaaatcagtatgtcaaagagatttctgcactctcatgtttattacagcactattcacaatagcctagaatcaacctaagtgtccatcaatgaatgaatggataaagaaaatgtggcatatatgctgtatttggccattcttgcattgctataaagaaataactgagattggataatttataagaaaagagacttaattggctcctggttctgtgggctctacaggaagcatagtgccaacatctgcttctggggcctcaggaagcttgagaacttgttcactatcatgaggatagcaccaagccatgagggatccacctccatgacccaaacacctcctaccaggccccatttctaacagtggggattacaatataacatgagatatgggtcaggacaaatatccaaactatatcatatgcacacttggccataaaaaaaggataaaatcgtgtcatttgtgacaacatgaatgagtagagaggacattgtggtaagtgaaataagctaaccacagaaagacaaatatcacatgatctcattcatatgtgaaatctaaaaacactgatctaatagagagtagaagagtggttaccagactgggaaagttagggagaagaggttttaacaatgtatcatgtatcaaaataccacattgtaccccatcaacatgtgaaattatcatgtgtccacttaataaaaaaaaagaaaatggaagagtcaagatactggggcacttgaagagatagaaggtgaattggcagtaaggaagagagagtctgaaagagcaggtcacagagtggaacattaaagtttataacattagaaatcaatttttaagttattgaaaagtttatagccatgaaagtgagtagctcaattgaagtgaaagtaaaagtcaatgaaagattaaattagaaaatatattgcttggcatttagtagttacttcagaaatattaataaatcttaagaaaattaagaacgccaaagcattcatagtgggccattatcataatacaaatgtatgtggtaatattttattctttctagtgaagggagtaattcaacagtcttgattataggttagaaaatgattctccaggtgtgacccactgaccacattcattgtatttgaattgcttgagcaacttgtttcagaagaaaatggaaagattttaagatggaccaatgaaattaccactgagtgtcttcaagaaatctcagccttgcctagaataacctgggttatctgtttctatggggtctttttgccttttgttttctttgttatttgcaatcctgttagtcatagattactgatagtaatgcaaatattcttgtccatagacatgcaaatgactgatttgggtggaagtataattaattttccttttttcaccttccatcaagaagtcagttttgaacctatcaagaaaatttatttcagtgttccttagtgcatagagatgtgtggctcttttaattttccataaaactcattataacatcttactgactccctcattaaataaatgagttaaacaaaaatcttagacaaatgttcattttatatttgtaagtcataatttatcctacttgaagcaattttcctttaacattcctaaaaatacagattcctatgccccatgctagacctactgaatcaaaatctcaggcctaaggcacaagaatttgcattgttagtaagcttttcaagtgatttttaggcatactatattatattaaccattaccattctaattctttaaacttgaattattgtgtttataattccaacttcatcaaagtaaactttttgttagcaaaaacggtagaaacccccttattcaataagattgggaccagtaataaatagattaataacaaatttaagttagatggaggaatcataagaagtattagatgtaagtccttaaaacaactttaatttaaaagacatgtgtaaataaatttgccactattttgatgacaaggtcaaagccttgcacggattcaatgagtggagtttcttgtggaaactatgccaatgatatgttgtcattcatttctcgttcactttctgtgaagacaactggggtaaagcaatctgaaatcctagagtatacaatttttcccatttgtttctagttgtcttgcccactgttaagttggcagcaactgtttgagtgtctcattttcccaacacatttggtttatttctcaaagaaacaacaatactactcttgttgtactcattttctcagtttacataatatttattttttattttatttattttttttttgagatggagtctcgctctgttgcccaggctggagtgcagtggtgccatctctactcactgcaagctccgcctctcaggttcacctcattctcctgcctcagcctcccaagtagctgggagtacaggcgcccgccaccacgccctgctaatttttttgtattttcagtagagaccgggtttcaccatgttagccaggatggtctcgatctcttgacctagttatccgccctccttagcctcccaatataatatttaattaaattgcataactacaagagcaagaacaaatggtgtaaacatatttaggaatgaacacagcttcctcttagaaactatataatttctgtgatggaaggagaaatgtacaggcattaaaagtagctcaaaggctttcagtttgcaatggacatcagtcaataagttgtacaggggtaccagaaagtgctaattgtaaatcagttaagtggaggtcagttaaggcagcatccactgtatcttaatttgtgaagtgaatgttctaaaactgggttcacttttgctataaaggaccagatgataaatattttaagctttgcaaaccatacggtctctatagcaaccattcaactctaccattgtagcaggaaagcaccatagatccatggatgtgctccaataaaactttattaaaacaggcagctggtctgaggtccatgtatatatcttgctgttttcatacaattttctaagttagtagtttcctgcctttttaacaatcacggattacttttaatcctctcctctgattttatgtttcaaaagccttaagaaaaacccacaaaatatatttattttgtaattttgggggtggttcttattttattaataagtaatcaatgatatataaaggctacccattaggtcagtatgaaataatcaacattactaactctaatgacttagttctggatagaaataaaatatattcaactatatatacataacttaaaacctgtatagctgtttctggtgtaaatatataacttttcgagattttttcaagtattaaatacaacttttgggaatccccacacctggctccctatgatgacgttcaagaattccttaggattctgggaatcttagaatgaaagtcactgctctgtaggaatgaatgaatgaatgaaaaagaaaacgaaggaagaagacagagcatgtctactaattataaattaatcatcaatgaatgtttattttataaataaatttgtcaactttaggttgccaaatctaacaagataccaacatggcattcatggtgatcacacctctagtcaaattttattttagttcattgactatactattaatatcctgaaatactcaaaacttctgtctcaattcggtgaataattcacttattaatcaccgtatacactacttaatgaatggaatggtgcttggaataaagataattacagggctaaaaggtttttctctggaggcagggcatagaattttgttgtctgactggaataaaacaaaattaatcaatattttctgcaaccagtggcttttgacttagtcgtctattaatatctatcaatcactataatctcagtcctatttcctccatttttctttttgctatcataaaaacttgtccatttttttcctgttagatctatatgtttctcctcttttcttttcatccaaacaactggacatcaacttagtacacatagtccaatttatccgaaccttacagaactcactgtttccatttacataacttacataactgtcaagctgaaatcactctcaaatttttttaattcaaaattttaatttaatttaataatatttatttattcattaattaatttattttgaaaataattttaacttgtattttacattcaggggtacatgtgccagtttgttacatgggtatatctcataatgctgagttttggggtatgaatgatcccatcatccagatgctgatttggtatgatttgactctgtgtccccacccaaatctcatgttgaattgtaattcccaatgtagggggaatgacatggtgggaggtgattagctcatgagggcagatttcccccttgttgttcttagatggtaagtgagttctcatgacatctgatggtttaaacatatggcaaatcccccctggctcacttgctctccttccgccatggtagaacgtgccttgcttcccccttcaccatctgccatgattataagtttcctgaagcctcccagccatgcttcctgtacagcctgtggaattgtgagtcagttaaacctcttttctttataaattacccagtctcaggtagttctctacagcagtgtgagaacagattaatacatgagcataatacccaataggtagtttttcaaaccttgccttcctccttctcccctctagtagtcccggtgtttattctttccatctttatgtccatgagtacccagtgtttagctcccacttataagtgggatcatgtggtattttgttttatgttcctgcattaattcacttaggataatggcctccggctgcatccatgttgtttcaaaggacatgattttgttatttttatggctgcatagtattccgtggtgtatgaaatggtttggaaggtggcccctataaatctcatgatgaaatgtaatcctcagtgttggaggtggggcctggtagggtcatggggatggatctctcatggcctgatgccgtccttgtgatagtgaattctttcaagatctggttgtgtaagggtgtgtggtacttacccccactcccattttctcttgctcctcctcggaccatgtgatgtgcctactccctctgtgccttccatcatgagtaaaagctccctggggcctccacaggcgccatgcagatgccatcaccatgcttcctgtacagcctgcagagatgtgagccaattaaatctcttttccttataaattacccagcctcaggtatttcttcatagcaatgcaagaatggcctaatcatactgtgtagatgtaccacattttattgatccaatccactgtcgatgggcacctaggctgactccatgtctttgctattgtgaatagtgctgcgatgaacatgcaagtgcatatgtctttttggtagaataactgattctctttgggttatataccagtaatggaattgttggcttgaatggtaattctattttaaatgctttgagaaatttccaaaccgctttgaacagtggctgaactaatttacatttgcaccaattatgtgtaaatgttcccctttctccacagcctcccaagatctgttgtttttcaatttttgaatagtagctattctgactggtgtaggatggtatctcgttttggttttgatttgcatttctctgatgattagtgatgttaagactaatctttgccaccaaaaaactaggaaaatacagtgtcacttgtcaaaataaattgttttactttgctttaaaaataatcaattgagtagtatatttcttccagcaaaattaagaagtaaacatttagaattgtacagtaccttgctgttaagtcttcgcacaagtataccaatcgaacataaaggccaccttaaactttcatttgaaatgaaagacaatttttaagaggttaagggctagtaatttcttaaagtcctgaagttaaattagctcaagtaaatgcaaagactttcctttaattaaagacttttaaatgaacactttaaagcatagttggtttctccctcaaatcttgtccaaagccactgtttacaactcagcatatcaaagaaggcttcagacatgattgtgaagctccctcaacttacagtgtgctatttgcaaccttagatgctatcattctggcttttctaacttttagcaacaataagcacacccttctcatttctcccccaccctgacttacccctcttttcatttaatatacaatttttctcagagtgttcttacacatctttaactgtaaatatgacaaaagcacacagtatagtacatttatcacatgtataaatgctgtatctagtcatacaattttccttttaaaaaagaaatattttattttcaaaaagcaaagactctaggaatcttttctagctgccagtcataaaaacataaattcctggttagtttcccaaatttgcctgaccataagaaccacttgtgatacttgtcaaacacatgtatgctgagtcccatccatgatctcctgaatcagaatcaccaggtgagaggcctgggaatacacattttaaacaaatgtccacagtgattatgattagtaaagcttgaaaaacatttcactaggatctttatgactgaataacctcacaaacataggaaagttactggaaaaaaatatgagcagaatttcagaattctgcctttgctgaaagtgtttgttccctcctcctctactcatcaagacctgactgcttatgcaactcccccaaaccatcaatgggaagagctgaaaatgattttaatgaagaagaaaagctgatgtttaatttcaaaactgacggtttgaatagaagggagaggcatgaatttatcttgattctaacagaaagcattgtatttgggtctacaaacgaaattggtttcatttttattttttgtaagttttcgccaaactctgtgcatatatagaggctgggcaagaaagaaagaaatccagaaatacggcatatgccatcccttatttatttccccatgcgaccagccaacagcttcttcacctagtccctgcttcaagctgactttcagtctacttctctatcggaaatggagcttccccaaagactgcctcaatgtcagttacccagaggccttttttccatcttgggctcctaaacttctatgatattaaatgatactaccctttctggaaattctccttagctttgatttctataatttaactctgtttcattccttcttttatagcctttcttttctctatccctttactgtagacatattgtacgactttgttcttgaccttctgatctctccacattcattccttcagagcatgtatccattttcttggtgtcaggcttcctgactatctgattattaccatcatataacgatgttggtgatgagcatagctaacatatcctaggcattttccatgtaggttataataagcaccctatataactcgtaccatttaattcttcaaccctaaatgatactattactaaccacattgtatgagacgaggaaacagattttcatcaaaaccctggaaagccaacgtgaggagcccctgtgtgtctcctttgttaatgactccgggcatcatggcatgtggattgccatggaatggggattaggaagcgcagcactgtgaaaacaccagaaaatacgttgatagcggtaaggacgctcatctctgcacattgtgacggttttgtttctgagtcaggtttgagatgagccaatcctgactccatggtgccaccagggatcacgaatttaataagatcttcgtggatgcttggaacccaactggtctcggttttctactttagggaaagagccacagcttgagtggggtggttttggtgtcacatacgcgattaataacacccaccgctgcagaggaatcaccgtggactactcctcctttcatcccatgctcttgcgatggatccctctcacctgtttactgatttcattcaaattcttcagcgaccacaggaccccgacttgccttctctatcctggttccctcactctgctttacaggcctggcctgctcgctgctcctcacaccagcgctgcacggctccctccacgcctccgccctgtttcctccatcagacaggactagcttcctccatctctgtcgggcaaatgcctgcccagccttcaagaccctcctcagatgccgcctccacgattaggcttctttcagacccctgagcctgtaacacgggctaccataactctccacctcagcccacattcccacagcactcgcgacgtccgcgaccctcaacatggcgcttcattctcttttagggtatttcctgcttgtttcctgcacacacagtcgcgcgaggcgcagtcctgagtgacccacgcacgagtggcccgcgcttccagccgcgccgccgcaggccagcgagggcagcctgagccgcttcccgccccggcgaggaccgtcgccagcccgctgctctagcaggaggcggttccacagcgcacccggcagcccagccaccgtcagcaccgcgcctcgggcgggcttttctcccttccgggaggcgcgaatcctcaggggctccttgagagggcgccagggagcagctgcgcgcggatgccttttggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggtgggtcctgcagcttgggcgggagcctcctccgttcttttcggacgcactccacccccgcaactccggtggaagccgtggcgcggagagccggctttgtggcctcccaggcttcgccctggcccctgtccgggctggacggaggccgggccgcggttcccggcgtctgtgcagagaggggcagcctcccgcgcggacgaccctggaaacaggatagacgggcaggtgacccgtgaccccgtacccacgagtttgggtcccctgaggcatctctccaggcctctgcctggggggtctgcattagtctgatctcgtagttcatgataatttcctttattagggattattattttctccattgtctcttttctttctagaaaacttattaattttttctaatctaatatgtacagtgaaaccaggatgaatcacacagtggttgaggtgtatatgggctttagggatatgggctcgaacctgcactcttgtcatttactagttttgtaatttgtggcaaattggttaatatgtctgaacttccatttactcattaagagatcaaatatctgaacctccgtttacacatttatactttcagacgttttttatacttttagaagactgtgaggattaaatgagagaacatatatgcagaaaataaattgagccaaatgtgaggaggaggtcgtaatggtaatttattagctttttaggaaaaaatacctgtgcactcatatccccgcttcttttttaactggcagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcaggtttatcctgaatgaatgtgagatttttactctgtgaatttcctgggaggagaggagagttatcttctgaaaactttataatgaaaatgcagacacgggtgtcttaagatcatcgtaataatcataattaatgctcatatagcactgtcaatgtgccaagaaattgttgtaggcactttgcacattaactttttttcaaatcactcttggttttttatttttttattgagatataattcataattataaaattcacccttttgtacagtcaggggtttttagtatatattcaagaggttcaccactgtctagttgctcagcattttcatcatctcagaaggaaatctccccctacccattaaagcagtcacatcccatcctccccctctcctagtccttggcaaccactaatccgctctctatgtgaaatcgcctattctgaatatttcctaagaaatcatgcaacatgtggccttttgtatctggctcctttcacttataacattattgaggttcatcattgttgtagcgcctgttcctttttatggctgcatagtattccattgtatggatgtatcattttgttcatccattcatcaactgatgaacatttgggttgtttcccctttttggctattgtgactaatgctagtgtgaatattcttatgtaagtatttttgtgggtgtatgttttcatttcccttgggtatacatacttaggagtaaaattgctgggtcatgtggtaactttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgttttccgtttagttcttttccatacatatttttttctcttttaaaacttggcaagttgcattttgaatcttcataaattatggtaacttaatatataaaatatggaatggtataaagctaatgttctggaagaatcattgctttcaaaatggcaaatcaacaattctaaaattagggtaaatatctagggtagatatgtagatgtggaattgctgtgtcaaaggataggtgaatgtttaactatataagaaaatgccaaaagttttctaaagtggttgtgccattttaccctcctaccaagaatgaattagtgctccagttacatccttgccaagagttgatggtgttatcagtcttttctcccagtctgagttttaccttttcagtttcttaatggtggtttttggatgagcagcttttttttgagacaaattctcactctgtctcccaagctggaatgcagtgatgcgatctcggttcactgcaagctccacctcccgggttcatgccattctgctgcctcagcctcccgagtagctgggagtgcaggtgcctgccaccacacccggctaattttttgtgtttttagtagcaacagggtttcaccatgttagccaggatggtcagaagcttttaatttttataaagctcagtttattttttttttcttttatggttactgtcttatgtctttgatctaagagatctttgcttaccccaaagtcaggaaaatattctacattgtcttttagaggcatcatagttttagtttttacattaaatctgtcattcatctcaaattaaattttggcatgatgttgtgagttcggtttcaagatttactttttttttttaaacatcttgatagccagttgtgccagcaccactggtgtttcctttttccattaatccactttggtatcttcataaaaaatcaattaactttctatgtattggtctgtttctggactctgttctatcgatacgtttgtctgtttttctgttggtatatttctcttgattgctataatttcatgaagtcttgagatcaggtagtgtgagtcctccgactttgtacttattaactgttaatttattaatttctgcagtgaagtttgttggattttctcgagaactgtattgagtccagatcatttgggggagatcaacatcttaatattgggcctcaatatttcataattttcaatgtagccatcttgcatgcctgtttaaacatttattcttaagtattttataattttacattactgtcaatagaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatctgcagagaaaacttttatcaaaatgaggacattccttttaaaactttgtttcttgggagtttttatcataacgatgtttaatgctgtcagatgcctctttctgtatctgttgagatgattatacagctttcttcattctgccagtggattatattggtttcattttcaacttttaaactaactttacatccctgagataaaccccacttggttgtggtgcgttgtcctttgggatattgctagatttgatttctaggtgtttgtgttttttgtttttttttaagatttctatattggtgttgatgggagatattggacttttgtatccttttcttgtaatgtctttttttgattttggtgtcaaggtgatactgggtgtcacaaaattagatggaaagtgctgtctcctttcctatttttggaaatagctgtgtagagatgggtatgagttgttctttacatgtttgatagaattcaccagtgaagtcagctgaacccggagggttttgtttggtttggttttagttttttgtgggaaaattaaaattttttaagagatattttcagatttttctgttgtgtcagttttggcaatttgtgtcttttaagaaaatttcatctaagttgttggatttattggcatagaattgttcagaatattcctttaatatgcttttaatgtccgtagaatctcatctgtattgcagtctcttcatattggtaatttgtgtttttgctatgttttcctggatcagtcagtctagctggaggtttctcaattctttacaagatcatttattttagatcgttaatgatcgtttagtacaggtgtattcaatcttttagcttccctgggccacaatgaaaggagaggaattgtcttgggccacacataaaatacactaacgataagctgataagccaaaaaaaaaaaaaaagcaaaaaaatctcataatatttcaagaaagtttatgaatttgtgttgggctgcattcacagctggcctgggccacatgtggccctcaggttggacaagcctgtttcaatattacttattttctctttttttcattttctatttcatttattttcagtcttttatttttttcctccctttaacttattttcagtttactttgctcttgttttattgcttcttaggaagggagttagatctcttcattccactttagtttcagttatagtcaacacattttgttttcattttcattccattcaaaatatcatctagttttccttgtgatttttcttttcatggacacgtgagttatttaaaagtatattgtttttaatttctactacatagagatattataggtatgttattgttgctgatttctaattcatttatagtatagttggagaacatactttcttagtgaatttccatgtagacttgaatgtgtattctgcagatgttggttcagggttttttgtttgtttgtttgtttgtttttttggagatggagtctcgctgttgcccaacaggctggagtgcagtggtgcaatctcggctcactgcaacctccgcctcccaggttcaagtgaatctcctgcctcagcctccggagtaactggaattacaggcacctgccaccacacccggctaattttttaaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttctaggtatacttagtgagttctctccactctgctgtgtcccaaatttgtgtgatctctggcatctccagtcagccctcagaagtgccagccactctgcagaggccttgtggagcctgcctgctgcatgcactccccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaagaaaaaaaaccttttaattttttaaagctgttctgttggttcctcacaaggatctgaagggattggtaaataggatgaaagaaattctgtctttcacatggagaaaaccaagtgtgacattaataaaaacgagcatgtctgtaggcaaagagtttcactgagctctgctagattcagaagcagttggacttacaacatcgtactttgcaaaacacatatattttatttacccaggaactaaagctaagtcagctgtggattaatagaaggtctgtgaagggtacttagactacagtaagattggggaagaaaattccatttccaaatctaagatatatcattcctttgtgccaagcacataatgatagtagagatttaagggggcccttagcacggaagcactgggttagtcagaaggtgaggtgagctgtcacacagccttgatgctagaatgagggtgccctggtactatcttatcagccatgacactggtgcattgggccatttttttgttttgttttttttgagacaggctcttgctttgttgctcaggctggagtgcagtgacatgatcgtggctcagtgcaccctcgacctcgtaggctcaagcaatcctctcacctccgactcccgagtagctgggaccacaggctcgtaccaccacacccagctaatttcttaatttttttgtagagatgggggtctccttttgttgcctaggctgattttgaactcctgggctaaagtgattctcctgcttccacctctcaaagtgctggattacaggcatgccagacatatgtaaacattctaaactatgtgacaatatgtgtaaagctttctcatgcattgtgagacaacacagcaggaatatttcaccatctgcctaaggtttaaaaggaaataactttaagcatgtgtctaaatagcaagtaatgttttagagcggattctcttaaattcagcttgggcatctgcaccatatacacagcttgagctgtcacctgacgtagagacaggcaacttcagtgcccgtgttcataggatccactgctttctcacagctaaaaccccagagtggcaccattaagtattatgttatgttactttagtcgataaacatataagcatacctccaaaggttgaatgtaggccacttgcagaaagtaggcagaatgctcacatttaattcttgatgatactgtgtttatatttcttattctttgaaattgcattgagaaaaaatactggcatctgctcaaagtaatttctttttcagttgacaatattaaagtaacgttattgtatcatttccctacttggacagagtgtgaaaattttaaggagcttgtctgccagaaatttcttcttcatttgcaaaacattaatgagttattatatttaaatgattttatttaatattaagtgtacttggtcaatgtggcatagaacatacaaaataaatctaatttaaaatcattaactattatatttataagaaagacttgctaatcataacactgttgataatgattctgaataaagcattatttcttttcctgaaaacaattgtagctataattcaatcatctaaattgcttattagttttatttctttttaattgtctttagctgaaattttaattttgattaattttctttttctccattggttttgtgtgtgtgtggaggtaaaatatacagaatatagaatttgccagtttttctatttttacgtgtatgcttcagtggcatttaaatacatgcaccattttaccttcccaccagcattgcacagggtttccgtttctccacatcctgcccaacatttgtttttctggctttcttggtttctgttttttgtttgtttgtttgttttgataatagctattctaatgggtgtgaagtggtattgcattatggttttgatttatatttccctagtgactagtgatgttgagcgtcttttcaagtgcttattggccatttgtatatcatctttggagcaatgtccgtgtatatcctttgcccagttttgaattgtggtatttgtctttttggagttctctatatagtctggatattaattccttataatgtatgtagtttacaaatattttctccattccctgggttgccttttactctgttgatggcggttcttgatgcacaaaagtttttaattctgatgaagtccagtttgtccacgttttcttttgttgcctgtgcctttgatgttctacataagaaatcattgccaaattcatgtcgtgaagcttttcccattttcttctaaaagttttctaactttagctcttacatttaggtctttggtctgttttaagttactttttgtatttggcattagataagggtccaacttcattttagctaaaattttatgtattttaaaatttattatggaaagcatgaaatgtttagttgaatagaaaattttgtgcagtggaattaactgaatctttaaaacctttttattatggaaatatccaaactattccatacatagaagaatataatgagtcccccatgtgcccaggccccagcattaattatcaatattttgccaatctcatttcatttacacacatgcccccacacacattttttcttagaaaattttaagtaaaatcacagatgttatgtcattttacccatgagtacataaacgtacatttcttaacgtggtatgtctttctgtcatcacctgttttgttctttatttttatatattatactatgtcattatcagaccttgtaaaattaacaagaattccttaatatgtcatatccagttaatgattgactcatttctactctagctaaagtacaatttaggaggaggtttgaggatattttttaacattaagatataaacttttataacaacggcttaaataattgttcctagagtctaatatttctattggcaaattggaaattagtatacatagacatagattctgctcattttactttcaatctaaaatcatagttaagattactggccaggcgcggtggctcacacctgtaatcccagcactttgggaggcagaggcgggtggatcacgaggtcgggagtttgagaccagcctggccaatgtggtgaaaccccgtgtctactaaaaatacaaaaaaaattattcaggcatggtgataggcgcctgtaaccccagctactcgggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatctgaatattcttacatttaattgcagaagaaaatagccacattttttaaaacaaaataatgtctttatatttatagcaaatgtcaaatttattttcaaatgttttttctccaatagttgatgagggccctagtcctccagagcagtttacggctgtcaaattatctgattccaggtgagcttatgttgtaatataattagtaaccagttattttaaaaatttaattgtattcattaaaaattttagtatctgtcttaagcccacagggtaattttgatgtaaaaaacaaaatagcttttttgaaaagtagattttgtgatctacttttaatggatttcctatcaatatataatgctaggctggaaaaaaaataagttaaaaagtgaagattaataatttcacataccgaataagatagattaaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttgaactttataactaaagaggtataattgaagaatgatgaatttcaaaaatatttgttatgtaatatataaggtacaatgtttatattaaaaaagcacaatataaaactaaatttaaaactgcactgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagcttaaaatagcatacgaaaagatagttttaatataagaagaaaaaagataatatactaattcttaattttagtaagtagacagttgtatatggatgttttgttaaatctttgttgacacagaatacataatttcctttttctgtttgtgtgagaagtaaagattgaacaaaaatatgtgagtgctaaacagtctttaaaaagtagataactttatcaaaaacagtaaggaccaatgggcaccacgcagagcaagcaaatagaagataagcttagcctttgagtagcagctttggtagtatacactaatgaattgaaaataggaactcagcagtgttttctaagatgacagattaaacaaacatccctccagaaagaggtaatcacttagactaatttcctcatcccctaggataaaatcttaactcagtgacttgaaaactattttggcccaacccattgagaaatgcatttttacattgcagcccagcacacatgtataactgaagcaagagttgtacttaacaatacttacttatccatgtgttatgcaccttgatatttcttattctcttttaccccttcctctgtgagtctgtgtgtattccttcccccgccccccataccgtacaggaaacaacactacattgatttcatgacccgctaatgtgttgcaacccctttgagatgatcctactagttaggatgagatacttctaataaaagttacaccggtagaaaaggccaatatatcataaggccttagatgatgacttagatagtactaataatacaacactttaggaaagttcgtttcattttatttttaggaaggacactaagtttcaaaaatttaaatttaaatgaaagagggtcttaaaactattgcaaaagggactcagctgaataatctgtggcacaggtttaaatcgtcttggaccacaccaccatgttccagggctcaccaggagccatccagatgagagaccacccagcccttgtgaccttgactaagaaattaaatccatgttatcagcacttttttaacttgatgtgatataaggttaacatattttgtaatcattgtatttataaatattttgtctaaatgttatggtattccaagttttccaaaagaatcaaccaaatacaagttataaataaacattatatttgttaagggagttaagctaaccaaatttataacccagatttagatacacaagaaaatcagtctttaaagttttaatagaaagcagtgtaatatatcaaacattaaacaactaaaaaagtatatgaatatttattttcacacacaaaagtccctcagacattgattcttaaattcaaaacaccaaagcattgtatgtaccttttcatgttttctaattgtgaagaaaataaattttacttaaaatgctaatatttgaataaagtatgcattcataattatgttcttgtctttaaagttaatttttcaaactgaactaaatcagttatgtcttcagtagatcttttagaaaggaagcaatcctacctcatctacttagaatttagtcctactaggaagatacactacaaatgtttattgtggtaatctttgaatagtaaaatgataggtgattttggtttcttttctatatgttcttgtattatatttttcaggtttttctctaagttcttttctgtgatttttaaatcagggaggaaaaattaattcagtctaaacacttaatgtttctcccacaagaagtatcctcatggctattttgttatttgtttcacttaggggaaaatggctttgttggcctcaaatagctgctttattagatgcaatgaagcaggggacatagaagcaaaaagtaaaacagcaggagaagaagaaatgatcaaggtaatgatgacattttatacagatgactgcattcacacatgcgatgtgactgtatctctttaaaatgttaaatggtcatttactgtcactttaaagatttacttaatagctttttataatgtggtgtttcaaatagactcatttttaattataaatcccatagttgatgtcttgtttatacaatgtggtagagaaatgagtgcatctaggagctaccttgccattatctccatggattagtatcttcttctggtagttccacatgctctttttaagctttcattttcttgttttcttgcttgtattttaaaatctaatttttaaaatagataacatgtacacgtggtccaacattttcaaataaaagcatgtgaagacgtatgcctgccatgcgtcttactcacctgtgtcccagcacctgttcgtctttccctttgtttttttatagcctcctaaaatttctttataaacatatgaatatgtttataattttcaactgttttacgctaaaggtagcctcctctatagtctagacttcaatttttttttttccttaaaattgtatcttggagagttttctactatgagtttgaatgtagaaagttttctctttttcttgcttttcctctctttctctctctctcaacagccacataatattccatttcagggatgtaccttaatttatttagtcttttatagatggaaatttaggctgtttccagtcttttgctcttataaacagtgctgcagtacataacattgaatatgcatcagtttgtagatgtgcgggtggacctgaaggtaaatttccagaagcagaattaccaggtcggggtatatgcgtttgtatttacgtaatgcttgagcttctgtgatgataatcactctatgaaacataaaaaatcatagcagaacttctggggccttagccctcagattttaaaaatatttttattaatagtacccgtcttctttgcattaggagaaacatgaatcacataaaacatgatttttattttatttttaaaatttgtgtgcgtcactaagctggaaataaaagttccttattccaggctaaattccctcatccgtagtcagacgcgttatccattgcaccagtggcctgtgccctctctaatcctactctttgttttacatcattgtaaaagttacacagacatcttcatatcaaggtgaaattctaaataatactgttaatataacctagataaatcaagtagttaattggaatctgatgaaaacatttaaggcttaattttttagactcacagaagccactgatctttaatgataaacatataccaggatgtgtctaaagaataactccccacttcttgacacatggcttttctgtgtcttggcattccatctcagtactgagcatcctgaaccttgctttgtttgtctctgttgggaatcacaggttgcatccagtctgacccagatttcctctgtaaggcattgtgggggccagagtggaaggctctaagagagggggcaagtgccttttctaaaatgcccttcgttcttataattagagcataaaaatttatgttacatttttctctactaccagtgcaatttaaaagcatctatcaaatctctgtacatacttcatgttagatttcctgtcataagtttgattttctttttagaatagtcttgatttcaaataatttcaaatctaaagctcaaacaatttcaatctaaaatgtaggtattttcttacagaagggaaatgttatattttttcattgcatgcacccagcacatgcgttgtagtcttgaatttccataatgcccctgtgaggtggatgtgagctcagcattacagacaagaagacagcctctgaccctccttacatcctcgtggtttttgtcagtcagttcatggaaatcacagtgatttcaaggtgtggtaagacaggatgtgtacccaggcccagctgactccagaggccactctcaatatttcatagcacattgcttctcaggaaacaggtcattggggaaatgcagatgggtttgtgacttacatttaattttatttatttatattttattgtatcatgtttaaattattttgcatctggatatcatcacaaaagtgttactgaaggcaacaattgcaaatatatgtgcagtgctttgcacttatacaaagatacaaagatacttacacaaagattgcctttttcactatttaaagcaattttcagacgaaatacaaagttttctgggtctctttggttagtcaagtacctggaagctctgaacagtgattatttaggactcttttcctttaccatttaattgcaggctctcctaatctctgtcagcccttcacctttatgaccttgccttatctaccagaacacagatccctcttactaaaggtagccttgtgttacctctgtcagcccttcagctttatgaccagaacacagatccctcttactaaaggtagccttgtgttacaggccctagcagggaatgttttcaggtctgggacccctctaatcagaactgtcacaaagatgtcatttgcacaaacacgttatttgtcatcactttctaagcagccctggaactggactctggccacagagatcccttaggagacatgagtccttaccattgctaattgcctgttctgtgggtgatcctaattgttgaatgcagattaattaacttatgacatgtggtagtaaacatctatccaaacttaggaggatataagaagctagtaaaagaggtgggttccaattagttaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatctagattagatcctgtgctgaaagagaaaccaagaaaaaagatgacattccagaagaagacaaaggaaatgtaaaacaatgtgaaatcaattatgtgtatgtattcttttccttttagacctacagatttgacagtgaagtgcttctcaaagtgctttcaaaataaattacctacttagctgggcatggtggtacatgcctataggcccagctactcgggaggctgagacaggaggattgtttgagcccaggagttcaaggctgcagtgagctctgatcaccactgccttccagcctgggtggcagagcaagaccgtgtctgaaaaaatgaaactgatggacaagaagagacgacacaatgtagcctctaggacagagcactgagctaaatgcttttcttttcttgaggcttcagttttcctaatcatcctaccacctcccaaagctagtcactcaggttagtcaatctctctattcattcatagaatgggtgtgatgccagtcaaaggctgtgctatggccaggacacaggggactctagccagcatgccctaatagaagtggggccttgtgctacccagtcaatgagtggccctcctcttgagaggtcatgaaggtcatctttgttgaaaagctccagcttatttaaaaaaatacaattagacctttttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacaggtagctatttatttacttatttccactattttcagtagccaatagaaatggcatgtagaaaacctacattctcttaaattactgtagtttttcacatttttgtctttatttctaatttatgagtgtggcaatattacctaaagaggacatcgtaagtttgggaaaagactgtcatgaaagaatatctaaaaattataaccgattctaagtatatacttgaagaaattcaggtttgactgtatctacttcataaatttatcatctttttataactattagaaccagagttagaagcagtttgactaatataaaaattatgtggattctgttagagtagttcaggttccttaaaataagaatagatcaactaaaaaactaagtataaaagctaaacaagtgaaattgaagcagttttattataagatttggaagagtgcaggatgtttatcataccacattattaatatttattactcttcctaggtagataagtaatgtcctagatttatgacatagaaaaacagagacgtttagctgtgagtgtacaagtataaatcaattaagtgccagattttgataatcaccagccgctcattcaagtcgtatgttgcaaagttactcttacccttttttttacattacttgataaaggcaatgtttaattacgtatttcctgttaactagctggtagtgttcatacctaaagtcagtaaataatgttaagaattttttccagctgagcaaatgaatatgtatctcattgtaagaaatcaagaagaggatataaaatataatcaggatgtggactctaaaacggaataagctctatgtcctgtaacttttatcacttgtaataatacagcattctcaccctgttaaatggaaatttagagcagccttaaattccggaataattaaaattgctatttggattgaaaaagcccttaggcaacatttattgaatattaggaaataacttttataagattagaatccattttttatagaaaccaaatttaaaagtatacatattttaataaaagtgttgtggtaataaccaaaattgaacacacagttttaaagctttttatatttagtagcagttgaatatatatggcatgttttacatagattaattttatttttctttgtttaaacaggagagccaaattgaaagccgacagatactgcaagtgactgggatttttgtttctgccttatctttctgtgtttttttctgaataaaatattcagaggaaatgcttttacagagttcttgagttgtgaaattattgtttagctagtttaaccaggattaaacaagtttaatcaggattcttcatggatgtactttttagctaactacagtttttcacatggaaatgaaacttacagttcacacttaatgtaccacagaatttttttctggatttcctgtcctgaagcatgaagtgtactagaaaccaattcttcctgcgctacttgtggaatctgtcttactggatcataatcttactttactttatataatagatgcttaatcagtgcctttaatagaagttagaaactcccaatccaatcaacaaggctttggttctaccttctaagtactacccagatcacagacaatccaaatatcagaactagggggctgggcagagaggacaaatcatctattagggagtgggacagaaagcagaaacattacaaaggagcaagtaggctcagaacagaggggagagtagtactggggaaactccctgctgaggacaggttagccacagtggatatgtatgtgatgcctttgtccttgtgggctggaatggaagctggtaagggaataggaacagctccagtctacagctcccagcgtgagcgatgcagaagacgtgtgatttcttcatttccaactgaggtaccaggttcatctcactggggagtgtcaggcagtgggtgcaggacagtgggtacagtgcaccgagcatgagccaaagcagggcgaggcatcaccttacccaggaagaacaaggggtcagggaattccctttcctagtcaaagaaaggggtgacagacggcacctggaaaattgggccactcccaccctaatactgcgcttttccaacactcttagcaaacggcacaccaggagattatatcctgcgcccggcttggagggtcctgcgcccaaggagcctcgctcattgctagcacagcagtctgagatcaaactgcaaggcggcagcgaggctgggagaggggcacctgccattgccgaggcttgagtaggtaaagtggctgggaagctcaaactgggtggagcccactgcagcgcaaggaggcctgcctgcctctgtagactccacctctaggggcagggcatagccaaacaaaaggcagcagaaaactctgcagacttaaatgtccctgtctgacagctttgaatagagtagtggttctcccagcaagcagctggagatctgagaacagacagactgcctcctcaagtgggtccctgacccccgagtagcctaactgggaggcatcccccagtaggggaagactgacacctcacatggccgggtactcctctgagacaaaactttcagaggaacaatcaggcagcaacatttgctgttcaccaatatctgttgttctgcagcctccactgctgatacctgggcaaacggtctggagtggacctccagtaaactccaacagacctgcagctgagggtcctgactgttagaaggaaaactaacagaaaggacattcacaccaaaactccatctgtacatcaccatcatcaaagaccaaaggtagataaaaccacaaagatggggaaaaaacagagcagaaaaactggaaactaaaaatcagagcacctctcctcctccaaaggaacacagctcctcaccagcaacggaacaaagctggacggagaatcattgacgagttgagagaaggcagcttcagacaaactactccgagctacaggaggaaattcaaaccaatggcaaagaagttaaaagctttgaaaaaaaattagacaaatggataactagaataaccaatgcagagaagtccttaaaggacctgatggagctgaaaaccacggcatgagaactacgtgatgaatgcacaagcctcagtagccgatttgatcaactggaagaaagggtatcagtgatggaagatcaaatgaatgaaatgaagcgagaagtttagagaaaaaagaataaaaagaaacgaacaaagcctccaagaaatacgggactatgtgaaaagaccaaatctatgtctgattggtgtaccttaaagtgatggggagaatgaaaccaagttggaaaacactctgcaggatattatccaggagaacttccccaatctagcaaggcaggccaatatttaaattcaggaaatacagagaatgccacaaagatactccttgagaagagcaactccaagacacataattatcagattcaccaaagttgaaggaaaaaatgttaagggcagccagagagaaaggttgggttacccacaaagggaagcccatcagacgaacagctgatctctccgcagaaactctacaagccagaagagagtgggggccaatattcaacattcttaaaagaattttcaacccagaatttcatatctagccaaactaagcttcataagtgaaagagaaataaaatctacagacaagcaaatgctgagagattttgtcaccagcaggcctgccctaacagagctcctgaaggaagcactaaacatggaaaggaacaacctgtacaagccactgcaaaaacatgccaaattgtaaagaacatcgaggctaggaagaaactgcatcaactaatgagcaaaataaccagctaatatcataatgacaggatcaaattcacacataacaatattaaccttaaatgtaaatgggctaaatgctccaattaaaagagagagactggcaaattggatagagtcaagacccatcagtgtgctgtactcaggaaacccatctcacatgcagagacacacataggctcaaaataaagggatggaggaagatctaccaagcaaatggaaaaaaaaaggcaggggttgcaatcctagtatctgataaaacagactttaaaccaacaaagatcaaaagagacaaggccattacataatggtaaagggatcaattcaacaagaagaactaactatcctaaatatatatgcacccaatacaggagcacccagattcataaagcaagtccttagagacctacaaagagacttagactcccacacaataataatgggagactttaacaccccactgtcaacattagacagatcaacaagacagaaagttcacaaggatatccaggaattgaacccagctctgcaccaagcagatctagtagacatctacagatctctccaccccaaatcaacagaatatacattcttttcagcaccacaccacacctcttccaaaattgaccacatagttggaagtaaagcactccttagcaaatgtaaaagaacggaaattataacaaactgtctctcagaccacagtacaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgagacacattcaaagcagtgtgtagagggaaatttatagcactaaatgcccacaagagaaagcaggaaagatctaaaattgacaccctaacatcacaattaaaagaactagagaagagcaaacacatacaaaagctagcagaaggcaagaaataactaagatcagagcagaactgaaggaaatagacacaaaaaacccttcaaaaactcaatgaatccaggagctggttttttgaaaagatcaacaaaattgatagactgctagcaagactaatgaagaaaagagagaagaatcaaataggtgcaataaaaaatgataaaggggatatcaccactgatcccacagaaatacaaactaccatcagagaatactataaacacctctacgcaaatcaactagacaatctagaagaaatggataaattcctggacacatacaccctcccaagactaaaccaggaagaacttgaatctctgaatagaccaataacaggctctgtaattgaggcaataattaacagcttaccaaccgaagaaaggccaggaccagatggattcacagcctaattctaccagaggtacaaggaggagctcataccattccttctgaaactattccaatcaatagaaaaagagggaatcctccctaactcattttatgaggccagcatcatcctgataccaaagcctggcagagacacaacaaaaaaagagaattttagaccaatatccctgataaacatcgatgcaaaaatcctcaataaaatactggcaaaccgaatccagcagcacatcaaaaagcttatccaccatgatcaagtgggcttcatccctgggatgcaaggctggctcaacatatgcaaatcaataaatgtaatccagcatataaacagaaccaatgacaaaaaccacatgattatctcaatagatgcagaaaaggcctttgacaaaattcaacaaaccttcatgctaaaaactctcaaaaaattaggtattgatgggacatatctcaaaatagtaagagctatctatgacaaacccacagccaatagcatactgaatgggcaaaaactggaagcattccctttgaaaaccagcacaagacagggatgccctctctcaccactcctattcaacatagtgttggaagttctggccagggcaatcaggcaggagaaggaaataaagggtattcaattatgaaaagaggaagtcaaattgtccctgtttgcagatgacatgattgtgtatctagaaaaccccatcatctcagcccaaaatctgcttaagctgataagcaacttcagcaaagtctcaggatacaaaatcaatgtgcaaaaatcacaagcattcttatacaccaataatagactaacagagagccaaatcatgagtgaactcccattcacaactgcttcaaagagaataaaatacctaggactccaacttacaagggacatgaaggacctctttaaggagaaatacaaaccactgctcaatgaaataaaagaggatacaaacaaatggaagaacattccatgctcattggtaggaagaatcaataccgtgaaaatggccatactgcccaaggtaatttatagattcaatgccatccccatcaagctaccaatgactttctgcacagaaatagaaaaaaatactttaaagttcatatggaatcaaaaaagagcctgcattgccaagtcaatcctaagccaaaagaacaaagctggaggcatcatgctacctgacttcgaactatactacaaggctacagtaaccaaaacagcatggtactggtaccaaaacagagatatagaacaatggaacagaatagagccctcagaaataatgccacatgtctacaaccatctgatctttgacaaacctgacaaaaacaagcaatggggaaaggattccttatttaacaaatggtgctgggaaaactggccagacatatgtagaaagctgaaactggatcccttccttacaccttatacaaaaattaattcaagatggattaaagacttaaatgttagacctaaaaccataaaaaccctagaagaaaacctaggcaataccattcaggacataggcataggcaaggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatcccgaatctacaatgaactcaaatttacaagaaaaaaaacaaacaatcccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtccgtgtggtggttcctcagggatctagaactagaaataccatttgacccagccatcccattactgggtatatacccaaaggattataaaacatgctgctataaagacacatgcacacatatgtttattgtggcactattcacaatagcaaagacttggaaccaacccaaatgtctaacaatgattgactggattgagaaaatgtggcacatatacaccatggaatactatgcagccacgaaaaatgatgagttcatgtcctttgtagggacatggatgaagctggaaaccatcattctcagccaactattgcaaggacaaaaaaccaaacacagcatgttctcactcattggtgggaattgaacaatgagaacacttggacacaggaaggggaacatcacacaccagggcctgctgtggggtcaggggaggggggagagatagcgatatgagatataactaatgttaaatgaagagttaatgtgtgcagcacaccaacatggcacatgtatacgtatgtaacaaacctgcccgttgtgcacatgtaccctaaaacttaaagtacaataaagaaaaaaaaaattccatagtggcgatatagaacagtttgtttaaccattcagtcattggaggatatctgggttgtttctagttctaggctattacaaataaaggtgctctgaacatttctgttaaaaaaaaaaaaaagttaagacgctacgtgttgcttaggtctgctttgttgaagcctgtctctttcagagttcctaaacacaatattcccatggcatctaatcctagtgagtgctccaaatccaggctgtgtatcagatgccacgggaaattctgcctcaggactgagtttggttcaagcatctggatgttgtcaaaagtccacgttgtgtgctggcctaatctgaaagaccctaactagttctagcctttaaatgccttctgtcatcaaatctagagttacatggcatttgtacaagctaggtagctgaggcacggaatcagccctataaaggagcttttggtgcttttgttgtaggtctagctccaacttggcactccagttcccatagctagactttctctcatcgtgtgttctgatccttggattaggaacaaagtaactactctgatacaaagcagtggtttcggttcccaactagtgactattttgcctcccaggggacatttttggttttcacaactgggatacggtgttagagggtagaggctagggatgctgcgaagcatgtggcagaatcctcttccgccccgaatgctaatagtgccaacgttgtggaggcttcccacccaagggcttggtctattccttgcttttgccagctccctaaaccttaaacacatttcaaatttatatgcataagcatctcctagggacctgcccgtttccaatatcgactactgagacccatccgtagagatgcaggcttaggaggtctaggattgggctgaaaatttgcattttaacaagtactccaggtcattctgaagcaagtgatacaaaccacacactgaggaacacgccttcaagagactgaatcttgcttcccaacactagcttgctatctgagaccatctgcctgctgctggctttcctggcacaaacattctgcatgtaggcacagtgtgctcctggactccatgtcacctcgttcaccctcatgttccctcggttcctgtccccagtccagcaagcagaactgattacagatcttaacagaagatacagattgaaaataacttgcctgttcccgtggactttatccactagtcaaggaggacaagtggacaaggggagagggtaggtgggggctccttccctgttcctcccattccactttatacaaaccccagctagaccactgggagagcaacagaggttaagaatgactgcatctaaatatttaatttggcccactcttcttctgtcttgaacacaagggtatcatgagttttgtttaaagcactactgaaaccaagataaattctggcttagcatgcccctgacagatcaatctagtaatcttatcaaaaagattgagaaatcggatggttgctgtgtctgggtagaaagaagtagacatgggagacttttcattttgttctgcactaagaaaaattcttctgccttgggatcctgttgatctgtgaccttacccccaaccccttgctctctgaaacatgtgctgtgtccactcagggttgaatggattaagggcggtgcaagatgtgctttgttaaacagatgcttgaaggcagcatgctcgttaagagtcatcaccactccctactctcaagtacccagggacgcaaacactgcggaaggccgcagggtcctctgcctaggaaaaccagagacctttgttcacttgtttatctgctgaccttccctccactattgtcctgtgacccggccaaatccccctctgcgagaaacacccaagaatgatcaataaaaaaaaaaaaaaaaccaagattacctaaaagcactaaccaaaggaaaactccctcacctcaacccgtgactgctcacatttttcagattgaataatttcaattgtattttaaggttgactctttaccacctccaagctgctcctgaacacaactattattttttaattttgaaaaatttttcacttctagaatttccacttgaggctttgttattactgtagtttcttcttctctgctgtgattttctatccatttattataagagtttttggggttttgattttagtaagaattataataactactttaaaaaatccatactaattccaacatctcggtcgtctcgaggtcagtctcgattgattgcctttttctttgaatatgtttcttggtatgtttgatataatgggattgaatcctgaagattgtaaaaactggatattttttgttcctctgaaaattgataattttttgtatttttttttctattgtatactttacattttcctccaagggttttaacatttctagttctcaaaacatttacatttatgttaaaaattatacaaagtagcttggtacagtggctcccatctgtaatcccagcactttgagaggccaaggcaggagggtcactcgagtccaggacttggaaaccagcctagacaacaggacaagaccttgtctccacaaaaaattattagggtgatacaaaaagtaattgcaggttttgccattactttcaatggcaaaacccacaattcctcttgcaccaacctgataaaaaataagctgggtatggtggtggtatgtgccggtggtctcagctatttgggaagtgaaggcagaggtgggaggattgcttgagcccaggagttccagaccaccctgagaccctgtctctacggggaaaaaaaaaaaaaaaaaaaaaaattagctgggcccacgtacctgtggtactagctacttgggaggcaaaggcagaggtgccagaatcacttgagcccagaagctcaaggctgcagggcactgtgattgtgccactgcactccagcctaagtgatggagcatgaccctgactccagataataataataattacaaaaaggaaagacctagaacaccaggttaaagtattctaaaatttagctgacttactctgctctctataaaacagggttgccacagaaaatatagcatgcccagttaattttaaatttcagataaacaaatacttttttcagtgtaagtataccccatgcaatatttgggatatgcttatactaaaacttattctttgtttatctgaaattgaaatttaactgggtattacataattatagcagcctgaccataaaagatatgtaggctgagcaaaattctactttaaacttcaagctttataataaatgcattattaatcaacaactattatttactgagacctgtgtagatccccatatttatttttaaatgtggaactaggaaatctatataaagaacatttatagaaatgaatgactgttctatagagctgaaaggaaaactctagcttttatttttctccccaaacttaagctttattttacatttgtataaacaataaaattaccactcaactttggaagcacagatcataatatgaaaataaagcaaagatcccagaaacatttaacaggcaacaaatctttgacatcatcttactatagcaactaaacgtataataatttagaacgatccattaattataagaataaattcttttacaaagcataactattaatattatttgaccatcataagaacaaacattttaactaaaacaccatgaatactttacagaaaggggcgagttgcagacacagtccttcttggatttcttttaacaccaggctttcttcccttttgacctgagctgggagttgaatatttcctctctttgccctctgaccctctagtctctgaagcatcttttgtactagaggtgtgtgcagagacttcctggaaatttggatctgtaaattgtgctgttgtatcttctaagcactgcagtgatctggatatagagctgttgctcttgcttgtataagtgtaatattctgattcaaaaaaggaagtgaaaggaagggagttgattacatttggctacagaaaaaaaaagatgacactaataataaaaataaataataattgtacttgtaatataaacatctgaaagttttagttctaagaatggcagtccacataagaaaattaggtaaaaataattaatatctattataattatttttctttaaccaaagaaaaagtataatttaaagatggctgtttaagcatcaaattgcagccattggtaaaagtagatattagtcatatttattaagtgacacacagtgatactgaaggcacttgtttctcagcaacatcattttttccccaataagaacgtactgcatcctagacgtgaaatgaaaataagctttaattttcaccacaggagggcgacaaccagagaactgagggggtacagatccattagaggaccatatccatgagcttaaaatgctctactgtaagagcaagaatttttaaagaatctcggtgaaggctccttttcaaaaaagcacaaagattaaagcctttgaaatgtaaattattttttgcagttattacattgaggacaaagttatagtcgcaaagttaagatttttataactatccctaaaattgatcctcagtgactccttgatctacatatgttaaggaaaaaggcaagacacagatatgtttaaatagtttccaattttcagtaatcagcttcaatataaggtatacccaaataatggtgaattaaatgaccatgaaagcacgttatagcagatgcccgctcatcaatatgccttgaaattaaaggtttataaggtgcataagggcaaaggttttgatgttgccattacattcgcaaaagtatgtgaggcacgtacagcatgaagttcactaagtgcttgcaacataaccagcactaaattttgttgaataaataaatgaatacttttgtatagcatctgttcaaaatctgatgtaaaaatgaaaataatctgaaaatatgcaaaactgaaatttcccacagacggctgccaattcatacaaaccataagatgaatttcaaaatgagaacgtgacaataaaatcaagtttcaaaatggctggccttttttttttttagcaaaacccatgttcaaaaaaaggaataagacatcaaatgttttgagaaccaaaattttactgctgcttttctaacaccctgttgctaacctgagcccccatcctcttactgtcaataacagattttcatcatcaaacacaagaaacacgctgggcacagtggctcacacctgtaatcccagcactttgggagactgaggcgggtggatcacttgaggtcaggagtttgagaccagcctggccgacagggtgaaacctcatctctactgaaaatacaaaaattagctgggtgtggtggtgggcgcctgtaatcccagctactcgggaggctgaggcaggagaatcgcttgaacctgggaggtggaggttgcagtgaactgagatcgagccactgtactccagcctgggtgacagagcaagactctgccttaaaaaaaaaagataaaaatacaataaacatctcataaaaacaaaataatcactattctaacaaaccacagtccacaaataagaagtttcaaaaagtaagtttaaaagaaaaaaatttttaccaaccactcacttttaagctgataaaactgcatggcttccttaagaaacaagaatcccttcgatgctgagcaggtcagtttggaaaccaccccacctcatttttcagtacttttttccaaatacttgagttgatcctgaggttctctatttctctcacatttgatccttgcatgacttactgaagttgaaaagttatttaagaagacacagtggtgttcttcactcatgtaatttgttcatgtatcaaataaaggatggagagaaaactggatgaaataccagaagttaagagatacatcaaaaacagtaccatgagggaaaaatttatagctataaatgattataaaacataagatactgaatcaacaactttactcctaaggaactaaaaacagagggaaaaagagggacaactaaaagctagcaaaattttaaaaatgataaagatagcagtggaaataagtgaaatagagaacagaaaagcaatatcaaaaatcaacaaaaccaagtttattctctggaaaagatcaaaactgacaaaaattttatctagattgactaagaaaaaaagggaatactcaaattacgaaactcagaagaaaaatgggtacattactaacaaatttttggagtaaaaaaaggatgtaggagagtaccataaggaactatacactaaaaaattgaataacctaaataaaatgaacaaattcctagaaacaaaaaacctactaagactgaatcagaaaagttgaataaacctattcagcaaggagattcagcaggaagatggcataagtaatcaaaaacccagcaacaaagaaaagcctggaccagatggcttcactgttgaattctacccaacgtttaaagcagaattaacaccagtttttctcaaactttttcaaaacgttgaagaggaggtaatgttttctaacttattctatgaggccagtattaccttgacaccaagccagacaaaggcaccataagaaaactacaaacaaacatcccttacaaatgctgatgcaaaaatcctcaacaaaataccagcaactcaaacttagcagtacactaaaaggattatacactatgaatgagtataattgactcctgaaataaaagtatattccaacacatgaaaatcagcgtaatatcacattaacataaagaaggaaaaaagcctcatgtgatcacattttaatcaaagaagaaaaagcatttgtcaaaatttaacccacattcatgataaaatgtacttaataaactataaaaagaaagaaaacactttaacataatgtcatacaaaaaacaaaaacacagctaatgtggtgaaagactgaaagcttttaccctaagagcaaaaacaaggatgcctgcttttactacttctgtttaatatagtactgaggattctagttagttaaaacatgagtaaaagaataaaagatattccaatttttttaaaagtaaaattatctgtttgcagatgacataaccttatatattaaaaatcttttggtttctgtgaaataaactgtcagatacaataaacaaaattcagcaaagctgcaggatacaaaatcaatacacaaaaatcagttgtatttctacaataacaataaactatctgaagaagaaatcaagacaacagtatcatgtatgatagcatcaaaagaataaaatacttagaaacccacttaaccaagaaaatgaaaaacctgtacagcaaaaactataaacatggcatgaacgtattaaagatgacaaataaatgaaaagacatcatgtgtttatggactggaagacaaaaccttgtcaagatgccattgttatctatagtcatctacagattcaataaaatcactataaaaattccaatatttgcaaaaatagaaaaacctattctaaaattcagatgaaatctcaaaaaatcccaagtagccaaatcaatcttaaaaactaacaaagttagaggactaacacctcctggtttcaaacttactgcaatgcttcagtacccaaaacttgtaccagcatagagacagagacaaagaccaatgcgatagaaataaagaaccaaaaaatatggtcatgatttttaacacaggagtcaacactattcaatgggaaacgatggtattttttgaatggtgtttaaaatggatatttacatatacccatatgtatgtatatatcccaaattagctttttgtctgtcatgtatgtggcagatctatttccccagtctgttgacttttgacttagaggcatttttctctcacacaaagtttcaatttttatggagtcaaatacatcagtcttctattcagtgacttcttcatgggaatggtgtttgattttaggatgataaagaagttgtagatatggataaattagataaactagatggttggacaacactgaatatactggatgccacagaactgtacatttaaacatggttaaaatggtaagttttatgttgtgtatattttaccaccaaaaaagggccaggcttagatgtttacatgttaggggtttggagtacctctaacatttattcccctccaggggaataatttataaacacccacacaagaaaagtagatactgacttcacaaatctccttacaagtcccacagcaagggctgtctgggaaagcagagatggaaaaagtcacataaacttgaggtcagtgtgagacctcccatcccctactctggaatcagatggaggaaggcaggtatgcaggctgagctggagagatgagctggggtgggcagaactgtcctcccatgagcccagaccttaactgctcccacatgctcccaggcatgtatcaaaccaagaaagcggctaggagggtaacacagctacctgtatacagggagccatgaaatatctgagctgcgcaagtgatgcacaaggagatggaagcagtctgacctttacacagtgacctggctcaaataatttcaggctctcaatcaggcgagctccactttctctctgaggtaggtaaacttgaggggtttaagtgggagttgaggataatggaaaagaaagcctggtagtatttcttctaattctgttataaataaaaagtaaaacaaatgccttttctcagggcccaaatgttaggtgaaaaaatgtcatctcagtcatgtgatgtggacttcagcagagcagtaccctcatggtcatttatcctttccctctgcatgttgtgtgctttttcagtttacaatgtacctgatccacttgtctcatcacactagctgcaaacaaggccactgcatgtcacaccaggtggccagcatgtctgtgaagggcagaaacgggggcagccaaacagctggcagaggccagctagtaagtacctgatgcccactccatagaggactccacacttaaaagacaagataagcaagtgtcaggctgcctcactagttatccccccaaataaaaaaataaaagtaacccctccagggaacatgtttgtgtgtacacaaagtacatgcacacagctacatgcaaacgggaaaggctgggaaggaaccaaatccacctctgaacaccagttacttgtggggaaggggcacgtgaagccaactgtcagcattactcaccttttcaactgatgagcttgcatcaattttggcaatttctcataaaaagacaattttcactccttgggtgatcacccaggtcctgcaaaactgagccaccaacaaccacctgcaccacttcccatgaggccaaataatggcttccctcaaagctcagccctcccacccacctcccagtcctgtaccgtgcaggggggctgccggcctcctggggtgcaggggggctgccggcctcctggggtgcaggggtccaggccaaacccaacctacagatggttggtgaaaccagcacgtatccaagggccttttccccacctgtgccatgtgccgactgcatagataggcctgtgcttgctccccctaggacagagattcccttttcttccattggaatgaggggtggggagatttgatggtattctgtacaggttggatgttaatctgatgtggtgctcttggaaaagcttgcctgagttcggcgctttctcagcacatggtgtgtgctgccccttcaagctgcagaaaccccagaaggtaagtgctaactgcaacccccatttactggtgagcagaggtcaggtgatctgcagccagccaagcagctgctaagtggccaacaggctggatctgcatctcacttgcagaggccctgcctggctgctgggactgccctgagactccctcctcctcctcctcttccctccacagctctcccagcttctatccacagctgtgctccaggtggggaacacctatggctgcaccagggtgcaactactcagactccagcgtgcagaaaggccccggctccatgctgtttccatatcccagcccaagctcgtctagagcttcagcaaatccaagcttccctgaattccctgcaagactaaaccaagccctacaacccccactacactggttagctgccagtccgagcccctgctgcctcctgggcccctgtctgtacagttctggagtcctacaagaatgctgagatcgtaagccgactctcacccaaagaggtaaacaaccagggacctccaggggtggagaacatacccagacaggttctgctgcctgtaggcttcatgtccttcccctacaacacgccatgcttgccaggctggaagaggggctccagaaacttgggaaacctgggcctgtagctggcatgtggaaaagaggcctggaaaagcaccactcctgtccatgaagcccccacatggaaccaggtaattgggaaatacatgggcaccaagcctgacgccctcctcagacccaggtgggaactgcagcagtgacttgccccctctgcctctggctgtaccactatgagagggaggaacatccaggtccacacgtgagtggagacaccaggtgtgggcaggttccagtgattgctgcagctgaaccttcccaagcaggtccatgcaagaccatctcagatgggtgtgcacctggattgggcaaggacacccctcagagagtgagggccactgaggggggctgtcacagagtccccttttcctgctcctagaacaggctgggggagtgtgggggagtgtgggggagtgtgggggagtgtgggggaggttgggggaggttggggaagtgtgggggagtgtgggggaggttgggggaggttgggggaggttggggaagtgtgggggagtgtgggggaggttgggggagtgtgggggagtgtgggggagtgtggggaagtgtgggggaggagtgtgggggagtgtgggggagtgtgggggagtgtgggggagtgtgggggaggttgggggaggttgggggaggttggggaagtgtgggggaggttgggggagtgtgggggaggttgggggagtgtggggaacctctcccacctcccagctgcttccaggagccacttctttcgagatgagacactctgctgcctgtctgttcccatttggctgcaatagaccattgacaacattcagagaacaagaaggggcctcacctgttttccctgacacgtcggaggcagatggacattcccaggggacctggggtagaacctgttcatctgcccacccccaggctgtgctggcttcatcttatctgtgtgatggtggcggtgggaattaccaaggggtcatcacacagaccatggacaagttctacaagagccagggagaagagccctgtccgtgcttgctgcccagcacccagctcacacacacacctcttatttgacagcttccccaaagcgggctttgcagtccaggctccccgagaagcttggggaggagactctgccagtctgaagggcctatccctaaaaaggtgccaccctcaccaggctcatcctggcaatcttggattatctttgctctgaggttttggagtgggggacagggagacagcagacactgcacatcacccatctttccagagagcatcagccctccagactggggcaggtcagacctccacttgggcgtttttctcactggttgccagttgggggaagcagcatttgtgagcacctgcctgtcttcccaggtcctgttcagaaaccccatctgtgcctttggagagactgccctgagcacacaggcccagcaaccaccatatacgacccccaggacctaatccccctctacatagggttcagtgcatgttagcagacactgggctcgattcctgcctagtccctgccagataccccatgcccacctcgtgaagagaatgaggccacacaaacacacccagaccgtcttggtgatggagtgcctggggtcccacttgcccacccttcattgctggttcagagccagctgtctgaccacattcctaccccgagatgggactttggggacattgtccaccagggtcgctgagcccttttaaagttccagacacatggccaactggtcccctaaaagtttggtacatgggataagccaaggcttttcttcaggaacaggctttccaccacgtcgctgcccaaggcccagggcatccccaagttcatgtggcgcctgcctgccatgtccacagcccatgccgagccctcctagagccactggaatgcttgttcctgggcatgtgatgaacccagacagcttccgccttgcaggacaactgtgcacatctggcagcagtagccagagggcccatagaagttggaggtgaaaccagatgctgtgagaatactttattaggcaaaaccgcatactataaaaatgctttaaaatgcagcaggagatgtgaagacacaaatgaacgagcgcatagtgacacatggctgtcagaacacagtgaaggatccacactgcttcccccctttacctagaaaaggagagttctaggccacctcctcctcctcatactcctcctccctcggccgtggcatcctgatattgctgatattcagacaccaagtcgttcatgttgctctcggcctcagtgaattccatctcatccatgccctcgcccgtgtaccagtggaggaaggccttgcgcctgaacgttgctgtaaactgctctgagacccgcttgagttcctggacggctgtgttgttcccagtgaaggtgactgacatttttagcccccagggtgggatgtcacagacggctgtttttacgttgttggggaaccagtcagcaaagtagctgctgttcttatcttgaatgttgaacatctgttcatccacctccctcatgggcatgcgaccctggaaaatggcagccgccgttaggtagcggccgtgacgggggtcacgggcagccatcatgttcttagcatcaaacatctgctgggtgagctcagccacagtcaaggcccggtactgctggctgccccggctggtcagtggggcaaagccgggcatgaagaaatgcagccggggaaacgggaccatgttcatggccagcttccgcaggtcagcattcagctggtcggggaagcacaggcacgtggtgaccccactcatggtagcagacaccaggtggttcaggtcaccataggtgggtgtgggcagttttagggtcctggaacatatgtcatatagcgcttcgttatctatgcagaaggtctcatctgcgttttctatgagctggtggactgagagggtggcgttgtagggctccaccacggtgtctgacaccttgggcaagagcaggatgctcaatgtgtttataatcctgtctgggtactcctcccagatcttactaatgagaagggtacccatcccagacccagtccccccacccagggagtgggtcagctggaaaccctgcaggcagtcacagctctcagcctcctttctgacaacgtccatcactgactccgtcagctccgcgccttcggtgtagcgtcccttggcccagttgtttccggccccacactgacctgtaagacagcacagccggtcactcgacggccaggtatacggtcatcagtggtcaccaccataatgcagaaagggccaagtgtcacgtgtgaggtgagagcaccattcgccctgcaggtggagcagatgaaaccccctcccccggagttacaggacagcagcttcccctctcttaggaattaagtcaggagtcaaacctgagaggggctaacctcactgcaggtggaacaaatgaaaacccctcccccggagttacaggacagcagcttcccccgttaggaattaagacaggagtcaaacctgagacgggctcacagaactcgctgcaggtggaacaaatgaaaccccctccccaggagttacaggacagcagcttcccctgttaggaattaagtcaggagtcgaacctgagacgggttcacagacctcgctgcaggtggcccattctcagggaaggcagtagccacggccccagctcaggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctcgtggccaaggcaggattagggcggcaggagaagcgcgagaaggaggagcagacgcacagcgacccagcccggcctccgccaacgcttaaacagccccgcgcccacctccctcagcctaggattgggctcccagaataagcaacagctttacttccacacaggtgcacccacctgtgactcccctggcgttgaacgtctgttggagaactcaggtgtccttgcgtggtcccttccacgttggggaaagctgctcagctggagaacttcctcccacgtctttagtaagactaaatccctagctgagctgaaactgaattttcctcccatgtgggaggggaagacgcttgtttccatatgcacggagtgcctttgcacctgtcctagattgatgacatatttttgtaattgatgaatcttttcatctattaggagatctgtcgttaggaaaggccttccacatgttaacaggacttaattatacgttttactttggagcagttcaaatctgcagtaagctatgggtgttagagatagtcaggcctctgatttagctagagtcttctttaggattagccctttcacctttccagaggactgcggtctccacacagagtgaaggtaatattggattcttaaagctgaggataggtgttgggttacgcctgctgtgaaagatgggccattgtcactttgcaggcttttagattacccaaactgaggagttatttcttctggtaaacatttttcagatggggtggggaatgcctcgatctaaccagtgaaggtatcagtaagcattagcaaatatttgaatctcttgcagaaagtcattggggtacattagagttgccagttctcacctggataggttccttaattttggacaggtttaactggaggagaaaattgctggccgtttgggtcatgtcaggcacagagctcacagtgctgagtcacctgttttagtgtcttgaaaagatttacccctataaacaagtgagacattaacagaaacaaagaatcccttctagggtgaaaagaatcatgaaagtgctgagttatactcttgtgattggtacttggcattagtaatttattaccatcattcagccagcccgaggggccctggactgaaatgcaatccctggcccatttctgttcttcttcagagtgttccggcccagttctatgtatgctgaccagcacgcccataagcttcattggccctttcagtgcaggggccttggctgcagctacaaggtcatttccttttacatggtcagtctctcttttgatgtcctctgcaattaattatagtcactttctggcagcaaagcagtattctaacaagctcaaaatctgaatgatgttgtatggaaaagcccttggggtcaggagtccccacccattccaaattgcagcataagcatgaagcactaaaaaatcatacttggaatcagtgtaaatgttaacttttaaatcctttccaactgcaggggcctagtaagttcaattaactcagctttttgagctgaggtcgaggccagcaaggcttgtgccttgattctcttgtgctgactactaatagcatatctagacctcctgttttcctgatgcataaaacaacttgcatctgttaaccactctgccttgggatggtcaaggagctcatctctcctacgtctggcctgctagatcaatttgtttcataacctgtgacatgctttggctgtgcccccagtcaagtcttatcttgaattgtagctcccataattcccatatatcgtgggagggacccagtgggaggtaattgaatcaggggatgggtctttcccatgctgttctcgtgacagtgaataagcctcatgagatctgatagtttatttatttatttatttttgatacatagtcttgctctgttgctcaggctggagtgcattatcgtgatcttggctcactgcaaactctgactcctgggttcaagcgattctcctgtctcagcttcccgagtagctgggattacaggtgcccacaaccatgcctgtttaatttttgcacttttagtatagacagggtttcaccatgttggccaggctggcctccatctcctcacctcaggtcatccactgccttggcctcccaaagtgctggattacagctgatggttttataaaggggagtttccctacacaagctcttttgcctgctgccacgtaagagatgtgactttgttcctcacctgccttctgccatgagtgtgaggcctctccgaccatgtggaactgtgagtcaattaaacctcttttctttataaatttcccagcctcagatatgtctttattagcagcgtgagaacagactaatacagcctgtatgccagaaaggctgggagcacctgtggactctgacagctaagtagctgggtttgtggtttggcaggctttaagggttgtgtctggagggtctagcaataaggcctgacactttcataaatgttctcctattatccactgctgccctttagcttccaggaccaccttcccttggtgtggggtcaaaaacctgtaggtgctgttctaatgttagtttattagctttgcctgctagaaaagtggtagcagcaatagctctaagacatcaaggccaccctgaggccgcctggtctatctgcttagaaaattaggctactggccttggaatgtcccccagttttgagacaagattacccaaggcctatgccttgctttttggtcacataaagaaaaaatggttcatccaacttggggactcccatggctgcagcagagctcaatttctccttgagagtattgaaggtttgcttgcagttctcattacgttctaggagctctaaatctttccctttagtgtatcatataaaggcttggctacatgtccaaatctgggcaaccataagcagcagtacccagccatctcctaaaagagcccacagtcatttgttggactgggacccttcggtgactaaaataacttttttatcttctagggttgttgatcagttccagtggttaagacagattccaaatatttaagtctttgagtcaaaatctgagccctgtatggggataccgtatatctgcaacttcccaggaaacttaccaacttaacagtattattatttgagtcttctttagttgggctagcaatgagcaagtcacctacatactgaataattgtgtccctttccagttgtagatttcttaagtccttagctagagcattttcaaataagtgggggctatcccagaacccttcagagacgactgtccaggttagttttgaggctgaatgtgtatctggattagtccattcaaaggcaaacatattgtgaatctggatgcattgagatgcagaaaaatgcgtctttcagatttaagaatgtaaaccagcttgcatcccctgggacttggtaagtattggggacaatgaggtgtatggagacaactgcatttcttagcgctctaagggttctgacaaatctgtacttgccattaggctttttatctggtaacatgcgagtattgtaaggagactctcatgggcttcataactcatatggcaagaatttggcaataaggggttgaatttcccctcatgcttcttgccttaaaatgtattgtctcttctgagggcgaggagcactaggctgaagttggatttgaatcggggaggtgtttagtgcatttcccagagcctgtgtggcccaaacttcaagatttacttgagacaatacctcaggtggtaaatgtgacagctcattcttaacttcttttttttcccctgaggggtcaggaacaaaagtaacactttctatgatttatgatctgtgaaggtgaccatgacttggtctcctgagtcaataaacttctccccagtaagagatcaggcattcagaccgtactaaaaaggtaggtgagaagcccagaggccctggaggacaacttagaagatacaaaaagcagttattttgggcttgtccatcatgaagagacaggagcccactgtattgaatcaggacagagtcatctgctcccacacctaataagaagttaatactcctacctgccactacaagagtcacctgaggcttctccatctctggatacctaatagtccaatgggagtggaggcaggaagtaacaggccctcccactttcaagtctgctgggctctgaggttggctcccttgaaagcacagtgcatttccttcagcagtggctgaccttcttacagaaggcacattgatttatatccacgacacagtggcccagaggcacagactgggactttcaccttctcacttcctctgtgagggccagggttaacgggctgcctctgaagtggtggagagcacaaggctgcagctagaagctgggccttttgggacatttggtttattttatgttttctctgccctattcctgtgatggaaaactgcaaaatccaaatctaaaatctgatccatgggagtctggaagcctaaggctgcttttggcggcttcctgcagatatcagaagcaggctgggctataaagtaaactcctagcaatgcctatcccttcttggagtaagggtcagtgttagtgtattttctcaaggtctaaattatccacccttgtaataaggctaggttttcatcttttccgagtaattttccagactttataaaaattaaaaagctttatcacaattttttttattccttcaaggagtcaaatgatcataattttttctctctatatcccactttcttcctaattcattcatcttttctagattctagttctcttttgagtcctaatcaggcacttctgtgcctcccacttgataggtgtcatgtccctggttgcaggctgccaccctattagcatgtgctctaccactcccataacacactgcttttcttttttcttttttttttaattatactttaagttttagggtacatgtgcaccacgtgcaggttagttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccgtgtgttctcactgttcaattcccacctatgagtgagaacatgctgtgtttggttttttgtccttgtaattgtttgctgagaatgatggtttccagcttcatccatgtccctacaaagaacatcaactcatccttttttatggctgcatagtattccatggtatatatgtaccatattttcttaaaccagtctatcattgatggacacttgggttggtttgaagtctttgctattgtgaatagtgccacaataaacatacgtgtgcatgtgtctttatagcagcatgttttataatcctttgggcatatacccagtaataggatgcctgggtcaaatggtatttctagttctagatccctgaggaatcaccacactgtcttccacaatggttgaactaaattacactcccaccaacagtgtaaaagcgttcctatttctccacatcctctccagcacctgttgtttcctgactttttaatgattgccattctaactggtgtaagatggtatctcattgtggttttgatttgcatttctctgatggccagtgatggtgagcattttttcatgtgtctgttggctgcataaatgtcttcttttgagaagtgtctgttcatatcctttgcccactttttgatggggttatttgttgttttctggtaaatttgtttgagttcattatagattctggatattagccctttgtcagatgagtaggttgcaaaaattttctcccacactgtaggttgcctgttcactctgacagtagtttcttttgctgtgcagaagctctttagtttaattagatcccatttgtcaattttggctttgcttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtagggaagggatccagtttcagctttctacatatgtctggccagttttcccagcaccatttattaaatagggaatcttttccccatttcttgttttttgtcaggtttgtcaaagatcagatagttgtagatatgtggcgttatttctgagggctctgttctgttccattggtctacatctctgttttggtatcagcaccatgccgttttggttactgtagccttatagtatagtttgaagtcaggtagcatgatgcctccagctttgttcttttggcttaggattgacttggcgatgcaggttcttttttggttccatatgaactttaaagtagctttttccaattttgtgaagaaagtcatcggtagcttgatagagatagcattgaatctataaattaccttgggcagtatggccattttcacaatattggttcttcctacccatgagcatggaatgttcttccatttgtttgtatcctcttttatttcattgagcagtggtttgtagttctccttgaagaggtccttcacatcccttttaagttggattcctaggtattttatcaaccaaagaaagtccaggaccagatggattcacagcctaattctaccagaggtacaaggaggagctggtaccattccttctgaaactattccaatcaatagaaaaagagggaaccctccctaactcattttatgaggccagcatcatcgtgataccaaagcctggcagagacacaacaaaaaaagagaattttagaccaatatctctgatgaacatcaatgcagaaatcctcaataaagtactggcaaaccgaatccagcaccacatcaaaaagcttatccaccatgatcaagtgggcttcatccctgggatgcaaggctggctcaacatatgcaaatcaataaatgtaatccagcatataaacagaaccaacgacaaaaaccacatgattatctcaatagatgcagaaaaggcctttgacaaaattcaacaaaccttcatgctaaaaactctcaaaaaattaggtattgatgggacgtatctcaaaataataagagctatctatgacaaacccacagtcaatatcatactgaatgggcaaaaactggaagcattccctttgaaaaccggcacaagacagggatgccctctctcaccactcctattcaacatagtgttggaagttctgaccaaggcattcaggaaggagaaggaaataaaggatattcaatcaggaaaagaggaagtctaattttccctgtttgcagatgacatgattgtatatctagaaaccccatcatctcagcccaaaatctccttaagctgataagcaacttcagcaaagtctcaggatacaaaatcaatgtgcaaatatcacaagcattcttatacaccaataacagacaaacagagagccaaatcatgagtgaactcccattcacaactgcttcaaagagaataacacactgcctttctgccatgcagcaggaaaacataaacatatgcaagtcctgcctggccagatcgtaaacaaggttagcctcttaaatttgtctacaaattttcaggcacctctgaaaactgttttagcttttccttgtatatggctagttcagacatagaaaagggtacatatacctatatagtgtcctttttatcatctgtcacttcccagagagggcaaacattcaagtttgccagctgataagaggccccactgcatgttgttctggtgaagctcacgtgttccgacagtggggtgtgtacttaagacaggactcgaagggcagggagaagacgatgaccagacactagataaccctggaaaactagaagaaattaataacatgttgcacacctcaccagaactggaaggagtctgactgtgttctcatggggttgtcggactggcagggggagttcagccccagctaagaaaagcctaatattaagaggcacttgcattaaaagggtaatcaattacgtgccatccctattttgtcttttcctccatcaaacatatagaagcccattttaattttttatcctgaccaagcatcagagaagcctatatgtaaagtatttcctcccatttagtttctcttctataaaacaaattaagctgcaaaaaaaggagtcagactgaacaggggaaatgggaaggctgtaacttgtatattgtaatgtactagtccattttcacactgctatgacaaaactgataaaactctgtcaggaaaaaagtgggatactgggtttagaaagtagggtccagctgccctataccagctcatcaaagatggcgttatggttaagaaatgagagaaaactgttaagaaaaagtcccatgttctccatcttgaggctaattgtttgcagagggttgtcataaaagaggctgtcactaaacaggtatatctgatcttatcatgtagggctgttaaataccacatttcaacttctagtcataatgatggagaggttattgctgattttttttctgataattaaggtacaaaaatactaggttccaagacatctctcttttttcagtgtcacttggaccagtggcaaattaaacaagcaatcagctaaaagtcagaggatcgctgaggaaagcaaaagctaaactgtttggggcctctttcctggggcagcctccaggctactacaaaacagaggaggtgagcagaaaggtgacaagatacagagcactcaggtgagggacagagagcacaaggtggacagtccaaaaagagaaagtggcaaacatcttgtttagccaaatccattcttctcaatattcccaagggcctctaaccctgtgagcttggcctctaatctgagtatgatgcccccgggcctctaatttttggggctgagtgtctcaccctaacattatgccctagggcctcttgcttaagtagtagtggatcatcattcttgcccaccagaatggcttcacgactctaaaagacggcccacttgccaggtgtcagctgactgattctgtgtggattgttttccttggagtgggggtcttgtcttggtgtcccttcatggtgttgctgaaagatgttgctggaaaagagggtcctgatacagaccacaaagtaggattcttagatcttgtgcaggaaaaaaattgaggtgagtcagagagcacagtgaaagaagcaagtttactagaaatgactccattagagttggacaccctcagcaaacaagagcaggaatgcattgtcttttgttagtgtctcttcttataagtaactataaagacaaagagttataattaaacttggaaggtgcaaatgtactcactaaagtcggggctattggttttaacaatgaccattaacccattgacctaagcaagctcattaatattatccttacaaaaaaaatgctgcactcctaggacatgtatacgtttttcaggcttggtggaatatgtcttgtatgaccacaaatattctccagttataatttgtggccagctaaaaaatgtggctattttcagaccatgagcattaatcttctagatgccttgtgagtacctagctactcatattaagatagagtattctagtcatgtttactaaactagaagcttgttattcatgagttcctctaacacaataagtctactgctcaaggagaaaatgtatttctcaggaattctgtgcattttgtttgatggaatttggtatgtttaccaaaatggcagaaaagagtgaaattagtcctcaaagatttctcaagattggatataaagtaagcaaaatgattataggtaatatgcaagttgatacagttgatattcaagagaaatttgaaacacaatgacatttttatttttacttatttattattattattattttgagacagagtcttctctgttgcccagggtggattgtagtgtaccatcctggctcactgaaacctccacctcccgggttcaagcaattctcctgcctcagcttcccaagtagctgcgattacaggcatgcatcaacacacccagctaatttttgtatctttagtagagatgggatttcactctgttggctgggcttgtctcaaacccctgacaacaggcgatctgcccacctgggcctcccaaattgctgggattacaggcatgagccaccactcccagccacaatgagatttttaaataattctaactgatttcctgctgttgagcagggagctgagcaaattcaacagatcatgggcctaaagtaggagaagactaaggacaaactctagaatgcatgtgattaaattaattacaattgaaaccaaatcaaatttaataaggctgtacctcttagtttcaagatgtttcccctcactttgaaatgtggtgttattcagtggaaaataacagggttccctgcagggattgattgactgagagctatggctcaggattaaaaatccttt

SEQ ID NO: 692 - DNA, 19778 bp, Homo sapiens
tcacatttgatccttgcatgacttactgaagttgaaaagttatttaagaagacacagtggtgttcttcactcatgtaatttgttcatgtatcaaataaaggatggagagaaaactggatgaaataccagaagttaagagatacatcaaaaacagtaccatgagggaaaaatttatagctataaatgattataaaacataagatactgaatcaacaactttactcctaaggaactaaaaacagagggaaaaagagggacaactaaaagctagcaaaattttaaaaatgataaagatagcagtggaaataagtgaaatagagaacagaaaagcaatatcaaaaatcaacaaaaccaagtttattctctggaaaagatcaaaactgacaaaaattttatctagattgactaagaaaaaaagggaatactcaaattacgaaactcagaagaaaaatgggtacattactaacaaatttttggagtaaaaaaaggatgtaggagagtaccataaggaactatacactaaaaaattgaataacctaaataaaatgaacaaattcctagaaacaaaaaacctactaagactgaatcagaaaagttgaataaacctattcagcaaggagattcagcaggaagatggcataagtaatcaaaaacccagcaacaaagaaaagcctggaccagatggcttcactgttgaattctacccaacgtttaaagcagaattaacaccagtttttctcaaactttttcaaaacgttgaagaggaggtaatgttttctaacttattctatgaggccagtattaccttgacaccaagccagacaaaggcaccataagaaaactacaaacaaacatcccttacaaatgctgatgcaaaaatcctcaacaaaataccagcaactcaaacttagcagtacactaaaaggattatacactatgaatgagtataattgactcctgaaataaaagtatattccaacacatgaaaatcagcgtaatatcacattaacataaagaaggaaaaaagcctcatgtgatcacattttaatcaaagaagaaaaagcatttgtcaaaatttaacccacattcatgataaaatgtacttaataaactataaaaagaaagaaaacactttaacataatgtcatacaaaaaacaaaaacacagctaatgtggtgaaagactgaaagcttttaccctaagagcaaaaacaaggatgcctgcttttactacttctgtttaatatagtactgaggattctagttagttaaaacatgagtaaaagaataaaagatattccaatttttttaaaagtaaaattatctgtttgcagatgacataaccttatatattaaaaatcttttggtttctgtgaaataaactgtcagatacaataaacaaaattcagcaaagctgcaggatacaaaatcaatacacaaaaatcagttgtatttctacaataacaataaactatctgaagaagaaatcaagacaacagtatcatgtatgatagcatcaaaagaataaaatacttagaaacccacttaaccaagaaaatgaaaaacctgtacagcaaaaactataaacatggcatgaacgtattaaagatgacaaataaatgaaaagacatcatgtgtttatggactggaagacaaaaccttgtcaagatgccattgttatctatagtcatctacagattcaataaaatcactataaaaattccaatatttgcaaaaatagaaaaacctattctaaaattcagatgaaatctcaaaaaatcccaagtagccaaatcaatcttaaaaactaacaaagttagaggactaacacctcctggtttcaaacttactgcaatgcttcagtacccaaaacttgtaccagcatagagacagagacaaagaccaatgcgatagaaataaagaaccaaaaaatatggtcatgatttttaacacaggagtcaacactattcaatgggaaacgatggtattttttgaatggtgtttaaaatggatatttacatatacccatatgtatgtatatatcccaaattagctttttgtctgtcatgtatgtggcagatctatttccccagtctgttgacttttgacttagaggcatttttctctcacacaaagtttcaatttttatggagtcaaatacatcagtcttctattcagtgacttcttcatgggaatggtgtttgattttaggatgataaagaagttgtagatatggataaattagataaactagatggttggacaacactgaatatactggatgccacagaactgtacatttaaacatggttaaaatggtaagttttatgttgtgtatattttaccaccaaaaaagggccaggcttagatgtttacatgttaggggtttggagtacctctaacatttattcccctccaggggaataatttataaacacccacacaagaaaagtagatactgacttcacaaatctccttacaagtcccacagcaagggctgtctgggaaagcagagatggaaaaagtcacataaacttgaggtcagtgtgagacctcccatcccctactctggaatcagatggaggaaggcaggtatgcaggctgagctggagagatgagctggggtgggcagaactgtcctcccatgagcccagaccttaactgctcccacatgctcccaggcatgtatcaaaccaagaaagcggctaggagggtaacacagctacctgtatacagggagccatgaaatatctgagctgcgcaagtgatgcacaaggagatggaagcagtctgacctttacacagtgacctggctcaaataatttcaggctctcaatcaggcgagctccactttctctctgaggtaggtaaacttgaggggtttaagtgggagttgaggataatggaaaagaaagcctggtagtatttcttctaattctgttataaataaaaagtaaaacaaatgccttttctcagggcccaaatgttaggtgaaaaaatgtcatctcagtcatgtgatgtggacttcagcagagcagtaccctcatggtcatttatcctttccctctgcatgttgtgtgctttttcagtttacaatgtacctgatccacttgtctcatcacactagctgcaaacaaggccactgcatgtcacaccaggtggccagcatgtctgtgaagggcagaaacgggggcagccaaacagctggcagaggccagctagtaagtacctgatgcccactccatagaggactccacacttaaaagacaagataagcaagtgtcaggctgcctcactagttatccccccaaataaaaaaataaaagtaacccctccagggaacatgtttgtgtgtacacaaagtacatgcacacagctacatgcaaacgggaaaggctgggaaggaaccaaatccacctctgaacaccagttacttgtggggaaggggcacgtgaagccaactgtcagcattactcaccttttcaactgatgagcttgcatcaattttggcaatttctcataaaaagacaattttcactccttgggtgatcacccaggtcctgcaaaactgagccaccaacaaccacctgcaccacttcccatgaggccaaataatggcttccctcaaagctcagccctcccacccacctcccagtcctgtaccgtgcaggggggctgccggcctcctggggtgcaggggggctgccggcctcctggggtgcaggggtccaggccaaacccaacctacagatggttggtgaaaccagcacgtatccaagggccttttccccacctgtgccatgtgccgactgcatagataggcctgtgcttgctccccctaggacagagattcccttttcttccattggaatgaggggtggggagatttgatggtattctgtacaggttggatgttaatctgatgtggtgctcttggaaaagcttgcctgagttcggcgctttctcagcacatggtgtgtgctgccccttcaagctgcagaaaccccagaaggtaagtgctaactgcaacccccatttactggtgagcagaggtcaggtgatctgcagccagccaagcagctgctaagtggccaacaggctggatctgcatctcacttgcagaggccctgcctggctgctgggactgccctgagactccctcctcctcctcctcttccctccacagctctcccagcttctatccacagctgtgctccaggtggggaacacctatggctgcaccagggtgcaactactcagactccagcgtgcagaaaggccccggctccatgctgtttccatatcccagcccaagctcgtctagagcttcagcaaatccaagcttccctgaattccctgcaagactaaaccaagccctacaacccccactacactggttagctgccagtccgagcccctgctgcctcctgggcccctgtctgtacagttctggagtcctacaagaatgctgagatcgtaagccgactctcacccaaagaggtaaacaaccagggacctccaggggtggagaacatacccagacaggttctgctgcctgtaggcttcatgtccttcccctacaacacgccatgcttgccaggctggaagaggggctccagaaacttgggaaacctgggcctgtagctggcatgtggaaaagaggcctggaaaagcaccactcctgtccatgaagcccccacatggaaccaggtaattgggaaatacatgggcaccaagcctgacgccctcctcagacccaggtgggaactgcagcagtgacttgccccctctgcctctggctgtaccactatgagagggaggaacatccaggtccacacgtgagtggagacaccaggtgtgggcaggttccagtgattgctgcagctgaaccttcccaagcaggtccatgcaagaccatctcagatgggtgtgcacctggattgggcaaggacacccctcagagagtgagggccactgaggggggctgtcacagagtccccttttcctgctcctagaacaggctgggggagtgtgggggagtgtgggggagtgtgggggagtgtgggggaggttgggggaggttggggaagtgtgggggagtgtgggggaggttgggggaggttgggggaggttggggaagtgtgggggagtgtgggggaggttgggggagtgtgggggagtgtgggggagtgtggggaagtgtgggggaggagtgtgggggagtgtgggggagtgtgggggagtgtgggggagtgtgggggaggttgggggaggttgggggaggttggggaagtgtgggggaggttgggggagtgtgggggaggttgggggagtgtggggaacctctcccacctcccagctgcttccaggagccacttctttcgagatgagacactctgctgcctgtctgttcccatttggctgcaatagaccattgacaacattcagagaacaagaaggggcctcacctgttttccctgacacgtcggaggcagatggacattcccaggggacctggggtagaacctgttcatctgcccacccccaggctgtgctggcttcatcttatctgtgtgatggtggcggtgggaattaccaaggggtcatcacacagaccatggacaagttctacaagagccagggagaagagccctgtccgtgcttgctgcccagcacccagctcacacacacacctcttatttgacagcttccccaaagcgggctttgcagtccaggctccccgagaagcttggggaggagactctgccagtctgaagggcctatccctaaaaaggtgccaccctcaccaggctcatcctggcaatcttggattatctttgctctgaggttttggagtgggggacagggagacagcagacactgcacatcacccatctttccagagagcatcagccctccagactggggcaggtcagacctccacttgggcgtttttctcactggttgccagttgggggaagcagcatttgtgagcacctgcctgtcttcccaggtcctgttcagaaaccccatctgtgcctttggagagactgccctgagcacacaggcccagcaaccaccatatacgacccccaggacctaatccccctctacatagggttcagtgcatgttagcagacactgggctcgattcctgcctagtccctgccagataccccatgcccacctcgtgaagagaatgaggccacacaaacacacccagaccgtcttggtgatggagtgcctggggtcccacttgcccacccttcattgctggttcagagccagctgtctgaccacattcctaccccgagatgggactttggggacattgtccaccagggtcgctgagcccttttaaagttccagacacatggccaactggtcccctaaaagtttggtacatgggataagccaaggcttttcttcaggaacaggctttccaccacgtcgctgcccaaggcccagggcatccccaagttcatgtggcgcctgcctgccatgtccacagcccatgccgagccctcctagagccactggaatgcttgttcctgggcatgtgatgaacccagacagcttccgccttgcaggacaactgtgcacatctggcagcagtagccagagggcccatagaagttggaggtgaaaccagatgctgtgagaatactttattaggcaaaaccgcatactataaaaatgctttaaaatgcagcaggagatgtgaagacacaaatgaacgagcgcatagtgacacatggctgtcagaacacagtgaaggatccacactgcttcccccctttacctagaaaaggagagttctaggccacctcctcctcctcatactcctcctccctcggccgtggcatcctgatattgctgatattcagacaccaagtcgttcatgttgctctcggcctcagtgaattccatctcatccatgccctcgcccgtgtaccagtggaggaaggccttgcgcctgaacgttgctgtaaactgctctgagacccgcttgagttcctggacggctgtgttgttcccagtgaaggtgactgacatttttagcccccagggtgggatgtcacagacggctgtttttacgttgttggggaaccagtcagcaaagtagctgctgttcttatcttgaatgttgaacatctgttcatccacctccctcatgggcatgcgaccctggaaaatggcagccgccgttaggtagcggccgtgacgggggtcacgggcagccatcatgttcttagcatcaaacatctgctgggtgagctcagccacagtcaaggcccggtactgctggctgccccggctggtcagtggggcaaagccgggcatgaagaaatgcagccggggaaacgggaccatgttcatggccagcttccgcaggtcagcattcagctggtcggggaagcacaggcacgtggtgaccccactcatggtagcagacaccaggtggttcaggtcaccataggtgggtgtgggcagttttagggtcctggaacatatgtcatatagcgcttcgttatctatgcagaaggtctcatctgcgttttctatgagctggtggactgagagggtggcgttgtagggctccaccacggtgtctgacaccttgggcaagagcaggatgctcaatgtgtttataatcctgtctgggtactcctcccagatcttactaatgagaagggtacccatcccagacccagtccccccacccagggagtgggtcagctggaaaccctgcaggcagtcacagctctcagcctcctttctgacaacgtccatcactgactccgtcagctccgcgccttcggtgtagcgtcccttggcccagttgtttccggccccacactgacctgtaagacagcacagccggtcactcgacggccaggtatacggtcatcagtggtcaccaccataatgcagaaagggccaagtgtcacgtgtgaggtgagagcaccattcgccctgcaggtggagcagatgaaaccccctcccccggagttacaggacagcagcttcccctctcttaggaattaagtcaggagtcaaacctgagaggggctaacctcactgcaggtggaacaaatgaaaacccctcccccggagttacaggacagcagcttcccccgttaggaattaagacaggagtcaaacctgagacgggctcacagaactcgctgcaggtggaacaaatgaaaccccctccccaggagttacaggacagcagcttcccctgttaggaattaagtcaggagtcgaacctgagacgggttcacagacctcgctgcaggtggcccattctcagggaaggcagtagccacggccccagctcaggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctcgtggccaaggcaggattagggcggcaggagaagcgcgagaaggaggagcagacgcacagcgacccagcccggcctccgccaacgcttaaacagccccgcgcccacctccctcagcctaggattgggctcccagaataagcaacagctttacttccacacaggtgcacccacctgtgactcccctggcgttgaacgtctgttggagaactcaggtgtccttgcgtggtcccttccacgttggggaaagctgctcagctggagaacttcctcccacgtctttagtaagactaaatccctagctgagctgaaactgaattttcctcccatgtgggaggggaagacgcttgtttccatatgcacggagtgcctttgcacctgtcctagattgatgacatatttttgtaattgatgaatcttttcatctattaggagatctgtcgttaggaaaggccttccacatgttaacaggacttaattatacgttttactttggagcagttcaaatctgcagtaagctatgggtgttagagatagtcaggcctctgatttagctagagtcttctttaggattagccctttcacctttccagaggactgcggtctccacacagagtgaaggtaatattggattcttaaagctgaggataggtgttgggttacgcctgctgtgaaagatgggccattgtcactttgcaggcttttagattacccaaactgaggagttatttcttctggtaaacatttttcagatggggtggggaatgcctcgatctaaccagtgaaggtatcagtaagcattagcaaatatttgaatctcttgcagaaagtcattggggtacattagagttgccagttctcacctggataggttccttaattttggacaggtttaactggaggagaaaattgctggccgtttgggtcatgtcaggcacagagctcacagtgctgagtcacctgttttagtgtcttgaaaagatttacccctataaacaagtgagacattaacagaaacaaagaatcccttctagggtgaaaagaatcatgaaagtgctgagttatactcttgtgattggtacttggcattagtaatttattaccatcattcagccagcccgaggggccctggactgaaatgcaatccctggcccatttctgttcttcttcagagtgttccggcccagttctatgtatgctgaccagcacgcccataagcttcattggccctttcagtgcaggggccttggctgcagctacaaggtcatttccttttacatggtcagtctctcttttgatgtcctctgcaattaattatagtcactttctggcagcaaagcagtattctaacaagctcaaaatctgaatgatgttgtatggaaaagcccttggggtcaggagtccccacccattccaaattgcagcataagcatgaagcactaaaaaatcatacttggaatcagtgtaaatgttaacttttaaatcctttccaactgcaggggcctagtaagttcaattaactcagctttttgagctgaggtcgaggccagcaaggcttgtgccttgattctcttgtgctgactactaatagcatatctagacctcctgttttcctgatgcataaaacaacttgcatctgttaaccactctgccttgggatggtcaaggagctcatctctcctacgtctggcctgctagatcaatttgtttcataacctgtgacatgctttggctgtgcccccagtcaagtcttatcttgaattgtagctcccataattcccatatatcgtgggagggacccagtgggaggtaattgaatcaggggatgggtctttcccatgctgttctcgtgacagtgaataagcctcatgagatctgatagtttatttatttatttatttttgatacatagtcttgctctgttgctcaggctggagtgcattatcgtgatcttggctcactgcaaactctgactcctgggttcaagcgattctcctgtctcagcttcccgagtagctgggattacaggtgcccacaaccatgcctgtttaatttttgcacttttagtatagacagggtttcaccatgttggccaggctggcctccatctcctcacctcaggtcatccactgccttggcctcccaaagtgctggattacagctgatggttttataaaggggagtttccctacacaagctcttttgcctgctgccacgtaagagatgtgactttgttcctcacctgccttctgccatgagtgtgaggcctctccgaccatgtggaactgtgagtcaattaaacctcttttctttataaatttcccagcctcagatatgtctttattagcagcgtgagaacagactaatacagcctgtatgccagaaaggctgggagcacctgtggactctgacagctaagtagctgggtttgtggtttggcaggctttaagggttgtgtctggagggtctagcaataaggcctgacactttcataaatgttctcctattatccactgctgccctttagcttccaggaccaccttcccttggtgtggggtcaaaaacctgtaggtgctgttctaatgttagtttattagctttgcctgctagaaaagtggtagcagcaatagctctaagacatcaaggccaccctgaggccgcctggtctatctgcttagaaaattaggctactggccttggaatgtcccccagttttgagacaagattacccaaggcctatgccttgctttttggtcacataaagaaaaaatggttcatccaacttggggactcccatggctgcagcagagctcaatttctccttgagagtattgaaggtttgcttgcagttctcattacgttctaggagctctaaatctttccctttagtgtatcatataaaggcttggctacatgtccaaatctgggcaaccataagcagcagtacccagccatctcctaaaagagcccacagtcatttgttggactgggacccttcggtgactaaaataacttttttatcttctagggttgttgatcagttccagtggttaagacagattccaaatatttaagtctttgagtcaaaatctgagccctgtatggggataccgtatatctgcaacttcccaggaaacttaccaacttaacagtattattatttgagtcttctttagttgggctagcaatgagcaagtcacctacatactgaataattgtgtccctttccagttgtagatttcttaagtccttagctagagcattttcaaataagtgggggctatcccagaacccttcagagacgactgtccaggttagttttgaggctgaatgtgtatctggattagtccattcaaaggcaaacatattgtgaatctggatgcattgagatgcagaaaaatgcgtctttcagatttaagaatgtaaaccagcttgcatcccctgggacttggtaagtattggggacaatgaggtgtatggagacaactgcatttcttagcgctctaagggttctgacaaatctgtacttgccattaggctttttatctggtaacatgcgagtattgtaaggagactctcatgggcttcataactcatatggcaagaatttggcaataaggggttgaatttcccctcatgcttcttgccttaaaatgtattgtctcttctgagggcgaggagcactaggctgaagttggatttgaatcggggaggtgtttagtgcatttcccagagcctgtgtggcccaaacttcaagatttacttgagacaatacctcaggtggtaaatgtgacagctcattcttaacttcttttttttcccctgaggggtcaggaacaaaagtaacactttctatgatttatgatctgtgaaggtgaccatgacttggtctcctgagtcaataaacttctccccagtaagagatcaggcattcagaccgtactaaaaaggtaggtgagaagcccagaggccctggaggacaacttagaagatacaaaaagcagttattttgggcttgtccatcatgaagagacaggagcccactgtattgaatcaggacagagtcatctgctcccacacctaataagaagttaatactcctacctgccactacaagagtcacctgaggcttctccatctctggatacctaatagtccaatgggagtggaggcaggaagtaacaggccctcccactttcaagtctgctgggctctgaggttggctcccttgaaagcacagtgcatttccttcagcagtggctgaccttcttacagaaggcacattgatttatatccacgacacagtggcccagaggcacagactgggactttcaccttctcacttcctctgtgagggccagggttaacgggctgcctctgaagtggtggagagcacaaggctgcagctagaagctgggccttttgggacatttggtttattttatgttttctctgccctattcctgtgatggaaaactgcaaaatccaaatctaaaatctgatccatgggagtctggaagcctaaggctgcttttggcggcttcctgcagatatcagaagcaggctgggctataaagtaaactcctagcaatgcctatcccttcttggagtaagggtcagtgttagtgtattttctcaaggtctaaattatccacccttgtaataaggctaggttttcatcttttccgagtaattttccagactttataaaaattaaaaagctttatcacaattttttttattccttcaaggagtcaaatgatcataattttttctctctatatcccactttcttcctaattcattcatcttttctagattctagttctcttttgagtcctaatcaggcacttctgtgcctcccacttgataggtgtcatgtccctggttgcaggctgccaccctattagcatgtgctctaccactcccataacacactgcttttcttttttcttttttttttaattatactttaagttttagggtacatgtgcaccacgtgcaggttagttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccgtgtgttctcactgttcaattcccacctatgagtgagaacatgctgtgtttggttttttgtccttgtaattgtttgctgagaatgatggtttccagcttcatccatgtccctacaaagaacatcaactcatccttttttatggctgcatagtattccatggtatatatgtaccatattttcttaaaccagtctatcattgatggacacttgggttggtttgaagtctttgctattgtgaatagtgccacaataaacatacgtgtgcatgtgtctttatagcagcatgttttataatcctttgggcatatacccagtaataggatgcctgggtcaaatggtatttctagttctagatccctgaggaatcaccacactgtcttccacaatggttgaactaaattacactcccaccaacagtgtaaaagcgttcctatttctccacatcctctccagcacctgttgtttcctgactttttaatgattgccattctaactggtgtaagatggtatctcattgtggttttgatttgcatttctctgatggccagtgatggtgagcattttttcatgtgtctgttggctgcataaatgtcttcttttgagaagtgtctgttcatatcctttgcccactttttgatggggttatttgttgttttctggtaaatttgtttgagttcattatagattctggatattagccctttgtcagatgagtaggttgcaaaaattttctcccacactgtaggttgcctgttcactctgacagtagtttcttttgctgtgcagaagctctttagtttaattagatcccatttgtcaattttggctttgcttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtagggaagggatccagtttcagctttctacatatgtctggccagttttcccagcaccatttattaaatagggaatcttttccccatttcttgttttttgtcaggtttgtcaaagatcagatagttgtagatatgtggcgttatttctgagggctctgttctgttccattggtctacatctctgttttggtatcagcaccatgccgttttggttactgtagccttatagtatagtttgaagtcaggtagcatgatgcctccagctttgttcttttggcttaggattgacttggcgatgcaggttcttttttggttccatatgaactttaaagtagctttttccaattttgtgaagaaagtcatcggtagcttgatagagatagcattgaatctataaattaccttgggcagtatggccattttcacaatattggttcttcctacccatgagcatggaatgttcttccatttgtttgtatcctcttttatttcattgagcagtggtttgtagttctccttgaagaggtccttcacatcccttttaagttggattcctaggtattttatcaaccaaagaaagtccaggaccagatggattcacagcctaattctaccagaggtacaaggaggagctggtaccattccttctgaaactattccaatcaatagaaaaagagggaaccctccctaactcattttatgaggccagcatcatcgtgataccaaagcctggcagagacacaacaaaaaaagagaattttagaccaatatctctgatgaacatcaatgcagaaatcctcaataaagtactggcaaaccgaatccagcaccacatcaaaaagcttatccaccatgatcaagtgggcttcatccctgggatgcaaggctggctcaacatatgcaaatcaataaatgtaatccagcatataaacagaaccaacgacaaaaaccacatgattatctcaatagatgcagaaaaggcctttgacaaaattcaacaaaccttcatgctaaaaactctcaaaaaattaggtattgatgggacgtatctcaaaataataagagctatctatgacaaacccacagtcaatatcatactgaatgggcaaaaactggaagcattccctttgaaaaccggcacaagacagggatgccctctctcaccactcctattcaacatagtgttggaagttctgaccaaggcattcaggaaggagaaggaaataaaggatattcaatcaggaaaagaggaagtctaattttccctgtttgcagatgacatgattgtatatctagaaaccccatcatctcagcccaaaatctccttaagctgataagcaacttcagcaaagtctcaggatacaaaatcaatgtgcaaatatcacaagcattcttatacaccaataacagacaaacagagagccaaatcatgagtgaactcccattcacaactgcttcaaagagaataacacactgcctttctgccatgcagcaggaaaacataaacatatgcaagtcctgcctggccagatcgtaaacaaggttagcctcttaaatttgtctacaaattttcaggcacctctgaaaactgttttagcttttccttgtatatggctagttcagacatagaaaagggtacatatacctatatagtgtcctttttatcatctgtcacttcccagagagggcaaacattcaagtttgccagctgataagaggccccactgcatgttgttctggtgaagctcacgtgttccgacagtggggtgtgtacttaagacaggactcgaagggcagggagaagacgatgaccagacactagataaccctggaaaactagaagaaattaataacatgttgcacacctcaccagaactggaaggagtctgactgtgttctcatggggttgtcggactggcagggggagttcagccccagctaagaaaagcctaatattaagaggcacttgcattaaaagggtaatcaattacgtgccatccctattttgtcttttcctccatcaaacatatagaagcccattttaattttttatcctgaccaagcatcagagaagcctatatgtaaagtatttcctcccatttagtttctcttctataaaacaaattaagctgcaaaaaaaggagtcagactgaacaggggaaatgggaaggctgtaacttgtatattgtaatgtactagtccattttcacactgctatgacaaaactgataaaactctgtcaggaaaaaagtgggatactgggtttagaaagtagggtccagctgccctataccagctcatcaaagatggcgttatggttaagaaatgagagaaaactgttaagaaaaagtcccatgttctccatcttgaggctaattgtttgcagagggttgtcataaaagaggctgtcactaaacaggtatatctgatcttatcatgtagggctgttaaataccacatttcaacttctagtcataatgatggagaggttattgctgattttttttctgataattaaggtacaaaaatactaggttccaagacatctctcttttttcagtgtcacttggaccagtggcaaattaaacaagcaatcagctaaaagtcagaggatcgctgaggaaagcaaaagctaaactgtttggggcctctttcctggggcagcctccaggctactacaaaacagaggaggtgagcagaaaggtgacaagatacagagcactcaggtgagggacagagagcacaaggtggacagtccaaaaagagaaagtggcaaacatcttgtttagccaaatccattcttctcaatattcccaagggcctctaaccctgtgagcttggcctctaatctgagtatgatgcccccgggcctctaatttttggggctgagtgtctcaccctaacattatgccctagggcctcttgcttaagtagtagtggatcatcattcttgcccaccagaatggcttcacgactctaaaagacggcccacttgccaggtgtcagctgactgattctgtgtggattgttttccttggagtgggggtcttgtcttggtgtcccttcatggtgttgctgaaagatgttgctggaaaagagggtcctgatacagaccacaaagtaggattcttagatcttgtgcaggaaaaaaattgaggtgagtcagagagcacagtgaaagaagcaagtttactagaaatgactccattagagttggacaccctcagcaaacaagagcaggaatgcattgtcttttgttagtgtctcttcttataagtaactataaagacaaagagttataattaaacttggaaggtgcaaatgtactcactaaagtcggggctattggttttaacaatgaccattaacccattgacctaagcaagctcattaatattatccttacaaaaaaaatgctgcactcctaggacatgtatacgtttttcaggcttggtggaatatgtcttgtatgaccacaaatattctccagttataatttgtggccagctaaaaaatgtggctattttcagaccatgagcattaatcttctagatgccttgtgagtacctagctactcatattaagatagagtattctagtcatgtttactaaactagaagcttgttattcatgagttcctctaacacaataagtctactgctcaaggagaaaatgtatttctcaggaattctgtgcattttgtttgatggaatttggtatgtttaccaaaatggcagaaaagagtgaaattagtcctcaaagatttctcaagattggatataaagtaagcaaaatgattataggtaatatgcaagttgatacagttgatattcaagagaaatttgaaacacaatgacatttttatttttacttatttattattattattattttgagacagagtcttctctgttgcccagggtggattgtagtgtaccatcctggctcactgaaacctccacctcccgggttcaagcaattctcctgcctcagcttcccaagtagctgcgattacaggcatgcatcaacacacccagctaatttttgtatctttagtagagatgggatttcactctgttggctgggcttgtctcaaacccctgacaacaggcgatctgcccacctgggcctcccaaattgctgggattacaggcatgagccaccactcccagccacaatgagatttttaaataattctaactgatttcctgctgttgagcagggagctgagcaaattcaacagatcatgggcctaaagtaggagaagactaaggacaaactctagaatgcatgtgattaaattaattacaattgaaaccaaatcaaatttaataaggctgtacctcttagtttcaagatgtttcccctcactttgaaatgtggtgttattcagtggaaaataacagggttccctgcagggattgattgactgagagctatggctcaggattaaaaatccttt

SEQ ID NO: 693 - DNA, 11881 bp, Homo sapiens
ctttactctcgtcaccccatttcatctgtgcgacccgagatgtcagtgccattgctgcatctccagctgcacagctgaagaagtgactaggggaggtgaagtcacactgcggcaagtggctggccccgccacccggctttgagaggcacttcctccagggcccccagctttgggccatccctcctggaccctctgagtaatggtgatgccagtggccactccctccctctcacaccttgtcgattcccacggttccctgcccgtcaccaatgcgtgtccctcgtctcccttaccagctccttctcctcgtggcccctgacattgaggtgctccagggctcccatctggagcctcctctccatgttcagtgacacccagcaggggcttgctggtcaatgttgagccaccggctctctagggccaggccagggaggatgcgaacagatgcacatctgtgcatttagaaaacacgggaccgctataaaggaattgcagcacaccattcacaaaaggagacgtacaggactctaactgggaatcccagccagccagctgattcccacagaaggctttcattgatttttgccagactcttgcatccacggccaacctatggttgtaactgacaaacgagactagttccaacaggaatgctgcttgatatttgtgtttaccttaaggaataaatgaaagtgaaacaacaaaaacctatgttggactttcactttgtcagtgagtgacttccttgctgagtcagataatagttgttaactactttgacaatttcttccatttttttttgtgctactgacgatgtaactgctatagataacacacatttacatttaattggcattattaacataacaaattcacctttgatctgtagcgtttcccaatttccatgggtaaatgctcccaccacatcagatttcgagccacgggctggcagtgcgaaaacgtggagttggttagagaagcccaggagcgcgccgtgatgcatccttctatcacccagacaattggaccgattgtggtaaaatgtcattaggaaaggatgagttgctattataacttaggtgaaaatttacacacagtgaaatctgctctttctggtgtgtaattccatgagttttgacaaacgcagtcctgtaaccaccaccacaaggaagatggaacagtcacccttcccccaggattcccctgtgctatcccagtatcatcaaaacagtccccaatcctaagtcctggcaacaccttccctatcattttgccttttccagaacgtacataagtgcagtaatacagtacgtggccttttgggtctggctgcatatggcgcagtgcatttcaatcagtgcggcttcaaaatgcacgcagattgctgtgtgcatcggtggctcgttccttactgcagagttgtattccgttgtaagggtgcatcacagtttgtttatacatcccccagataagagacatttgagttgtttccagttttttatttttattttttacaaataaagttgatataagcattgacgcacaggttttcacatgaacactgatttttttgttttttgagacagtctcattctgttgccatgttagccaggctcctctggaactcctgacctcaggtgacccacccacctcagcctcccaaagtgttgggattacaggcatgagccaccacacccgacctcaacatattttttaaaatgagccttgacctatttacagtacctcacatcttatacaaaatttaactcaaaatcagagacctaaatgtaaaattataaaactcttagaagaagacagaagagaaatctttgtgactttagagttaggcagagttcttagagacaacatcaaagtcaccattcataaaatttaaaaatggataaattagacttcattaaaataaaaacctctgtgaaattgttaaaagaataaaaacttacaaacagaacatatttgtaaatcacatatctgacaaaggacttgtatccagaaaatgaacagaaccctcaaaattcattaagaaaacagtcaaccaaacgaaaaattaggcaaaaagattcgatgcctgtagtcccagctacttgggaggctgaggcaggaggattacttgagcctgggaggcagaggttgcagtgagccaagattgcaccactgcactctagcctgggtggcacagcaagactctaaaaaaaaaaaaaaaaactgtctaatgactgcagtaccatttattgaaaagacagtcttttctccactgaactgcctttgcatgtttgtcaaaaatcaattaactatatctgtgtgggtctggccaatgccacactgtggtattacaggtttatatcttaaaatcagcaagtgttagccctccaacttggttcttctttttcaaaattgttttagctattcttattcttgttctttgcatttccatgtaagttttcaaataagactcctgatacctaaagaattcctacggggactgcattgaatctagagatcaattttgtggggactgacatcatttaacaatgttgagtcttccaacccatgaatgaactcagtaggtctgtccatgtgcttagatcttctgtgatttacttcatcagtatttcataattttcagcataaaatcctgcacatatttcacttttcagttgatttttatacactgactttgtatcctatgaccttgctaaagtcattagctagttctgtgaaattgtttttacagatgccatgggattttctacattgacactcatgtcatctgtgaatagggacaattttatttcttctttttcaatctgtatgctatttcattttcttgccttaaggcagtgcccagaacttttagtacaatgttgaaaaggagtcaggagagtgggcattcttgcctgttttacaatctgagggggaaggaattcagcctttcacccttaagtttgatgttagatgtaggtttttatgtggtttctgttcatgaggttaaggaaattcccttctgttccaatttgctgagagtttttattatggctgcttaatatttgtctatatctgttgagatgatggtgtggccttttcttctttagtctgttaatatggtgaactaattgaactagccttgcattcccagggtacactccatttggttatattatccttttacatattgttgcattcaatttgccaatattttgttgaggatttttgtagagacttcagaaaaatctaaagtctttgccatagcctacaggatctcctgtcgccattacctccctaatcttgttgatgacgggatattagcctgtaggatatttttcttgaaatatcattgtcaggccgggcacgatggctcacgcctataatcccagcactttgggaggccgaggcaggcagatcacaaggtcaggagttcgagacagcctggccaacatggtgaaaccccatctctactaaaaatacaaaaaattagccaggcatggtggcaggtgcctgtaatcccagctactcgggaggctgaggcaggagaatcacttgaacctgggaggtggaagttgcagtgagccgagaccgtgccactgcactcctgcctgagcaacagagtgagactctgtcgaaaagaaagaaaagaaaagaaaagaaaagaaaagatatatcattgtctagtattggtgtcagggcaatgctggcctcatgaaatgagtttggaaatgttttcttctattttctggaggagactgtataaaattggtattagttggtagaatttgctagtgaaaccacataggtctggagttttctctgtggaagggttttaaacagtaaattccatttctttagtacctgtagggctacacaggttatctattgttgagtgggtttcagcagcttgtgttaggcagaataatggcttccagagatgcccacatcctaatccctgggcctgcgcatgttatgttacatggcagaaagcgaatccaggttgcagatggaactgaggttgctaattggctgattttcagataggaagattatcctggatcatccaggtgggcccactgtaatcacagggtccttaaaaatggaagatggaggcagaagaggaggtcagaatggtgcaatatgagaagaccttgacttccttttttggctttgaagacagaggaaggtctaggagccaaggaatacagacagcccctagcagctgggaaaggcaagggatggaccccacccagaaaggagtacagccctgcgacacttggatttttgccccatgagaactgggccagacttctaacctacagcactgtaagaaaattgactgggaatgttttaaggcataaagctcatggtaatttgttagcatagcagcaatagaaagctaatacagtgagaggccgtgtttctcaaggaattggtccatgatttcttctaagttgtcaaattgattttacaatgtatttatttagagttgttcataatactcactactcactatcctttaatgctcgtagagcctatagtgacaccccgttttcatccgtgaggctgctgatttatgtcttctctctttttcaaaggaccatcttttaatttcattgattttctttagttttactgtcttcaattttattggtttccactctttattatttccttttcttctgcttcctttggttttaatttgctcttcttttactagtttttaaaaattacctttgctttcttggtgttacttaattgtacacttgcatcatttagttttaataatggctgtgtttaacaaccagctggccacattctgaaccctgcggctcccttgtgtgaggttcccaggcctggtcagtatcccccacccagcctctctctcagctccaggctgtctgctgctgcctgtcagcacccccacctggatgtcctgctgacatctccatataaacatcaacagggtccacctcagagccccagtcactcccctgttctccaagctcccactctggtaccagctcctccccacgcccatctgctccatcccctcgactcctctccccacaccctgcatcccgccagcagagccctgagctctgcctcagccccatctggagtctgcacacttctcacagtcctatgtcttcaccctgccccacatccttgtccagctgccccctggatgctgccctgggctccctgcccctcctggcccctgtgtcatctattctcaccacaacagtaagaaaaggtgaggccgggcacaggggctcacacctgtaatcccagcactttgggaggttgaggcagcaggatcgcttgagcccaggagctcaagacaagcctggaaaacatagggagacctctacaaaaaaatgaaaaaaattagctgggcgtgacagcttgcacctgtggtcccagctactttggaggctgaggtgggaggaccacttgagcctagcaggtcaaggctgcagtgagccatggtcacaccactgcattctagcctgagtgacagaacaagaccctgtctcaaaaagaaaaaggtgggttacatcaggtctctcctctgcacccaactctcaacagccccacctcaaagaaaatcccaggtcccttccacagcctccccaggcggccctcccttgcaactcctccctcggtctctgcctgctccaggcctggttctcatggcttttcctgaagtgctttggcctgttcctgcaggacctttgcctctgctatccccttgtctacaaagcacccccatggctcactgctgcgctcctgtgcctggcccctcctcagaggccttccccaccactgaggggaaacagcagtgcctacccctcttcccttcccactgggctctgtcttccttgcctggccctcccctgaagcatgtgtatttatcatggtccagccctctcccctcctgtcctaccacttcctgccctagaacagtgcctggctcgtagtacccaaccagatttgttgaacaaatgaatgaataagcagcagcccagagaacacctgctaggatgagggcacagcccttggcagggctgacaagctgccggaggacccgaaattgtggattctgcaaatggccactctctggccttcctgtatcttcccagggccagagcccttgccctgcctgccccagactggcccttccaactgcccatccctgactgctactcctgcagcctgcagggcttagcctggccatcaccagctctgggaggcctttccttggcttcacccagctcagcagacttctcagctccaactgcctgacacacacgactgctcaacagccacagtgtgaatgaaataatgaatgaacaagtgaactcataaaaccacagctgctgagggatggggtgaggacctaggcccaccaccctccctgccatcctcccacactagggcccgggtcagcccagcccaggagcagggacccaataatcactgagggcctgtgggtgtcagcccagcacacctctcagcccatcccaagacagtgaggacaggaaagcaggctccagccccacaggaggaagtcccacctcccccgtcaccactccctgcctcacttcgagccccggtcacactccttgaccacagttcccaggatggcagccaaagggaaggcagagaaggggttccttcctgacctgcagacaacaagccgcgatgaatcaggaggcggagccagaacccacccccaagcagcccaagcccagaccctggggcgcctcgccaccctctccctggagggtctgcttaacagtccagaacgaacctggatgcggccaatgaggagagagactgcagcccaactcccattccgatgctctgagtgtgtgagggcagagtgcacgcagtcccacctcccaggcctcgggctcagcagcctggcgctggtccagccccctccctacagcccccaggtgcccgttcctccatcctcgctcccagaaatcctctcaagagcacctggcccaaagcctccctctgctttacagaatcgctgctgagggcagcacacctgggggcagaggggacactggggactgcagttaggcccctactagtggcactcctcccatagggacgctttccacaccccgggccagaccctggtggtcacagaggcctccagggccagcctggtcctgacacagccgagcgcccggcctggcctccccacaaggccccacactctcgcctgtccactgttcccactgtccagccttggtgctcacctctgaatgctgaaagcctagaatagattcatccccagcccagccccaagtcctcctgtcttccaagcctctgctgaggcagcccctctccccatcaaacctcaccttgcccctttctcaagtctacgctagatcttccaacactacctctaaagcaccccttgaccttggcctcatccaggcgctggcacctcctgtctgaaacctgcctgccctgttgtggccacacatgcccggccatttctcgtggtcctccctccgctgcctgtcagttcaacatcgtccccttcttggcctcccattcaagcctcccacagcaccatcagcaccgcaggcccactgctgcccccacaggcagatcacttggcctctctgagccatgatttcctcatctgtaaaatctacttcgaagactcctgcgaggctgtaaaggcagcaggtacccaatggctggcagactgcgagtctgttccccactctgccctagccctgaggcctcccgccctggggaagctgttactccagcatcagcctggactcctgcctccagcctgccctgctgggaggggctccgtgcaggccgtggctctgctccgagcttcctgcgtgtcgtgttgcggcaagaggcgagcaggagaggggctgaggagaagagccaggtggccaagcaaagggactgcagggaaggccaactactgaccccatgtttttctgggcctcaatttgccctcagctcagtaaaactgagatttctacaagtgaggcctagagccagggagaggagagtcctgccccagactggccctcccgactttaccacctgggggccggaggggctgcctgggcccgcaagagcaagcctctggtgcactgggaaagctgagaaacaaacacaccagaatccgagtctgaaaagcccagagcccgggttgccatggcaacctgcagccagctccagcccgggactccgccagcctgggtaggggccgggactcgccaggcacggctgctcccagctctgaggcctcctccttgggcttggccctgtttctgcttggacacagaagtggtgcaaggccacagagaggcacttctcccctgtcaggtgggccaggcaggcctgggctcccctgggctcccactgccagctttctcccagagtaaggcctggcccctgggcctccagagtccagcacctctcagcaccccaccccggcacccattgctccagcacccatcactccagcagctgtcaagcccatcagctgcctgggtcaccacagcaccagtgtatggacaggcctcaggcgccggccaggtcagcggccttgaggctgttatgtgggcaccgatagaggggcagtgagatgattccctgccttacctcacagctggggggtgccagcactagtgtgaagctttctacgtgatttttctcctttaatggcactcctgacagatgaggaaacaagctcagagcaattaagcgacttcccaaggtacagagctgctgcttggtaagaagcagagacttgcaactcctgggcccaggttcctgccctggagcctgttcctggatgccctgggctgagccctgcacgtcagcagagcccatcacccaaccactcacctgaccccccggccacagggctgtgcccagtctacacagacacacagcagaaagaggatggccttcaggtttccatttaatggccaagccagcactgccaagatgtcctcctgcctgagaagcccacccacgctggcacccctcagcctcactagcggcatcccagtccagtcctggtgtggggcctcatctcagctccttcagcaagctgttgacagagcccagcagctcctggaagtagccctcgtcctcaccatcctgcagctccaggctggccagcacctggtactcagcctgcaggctggccagtgtcctgccgagctgggggtcctgacggtagcggtcccggcaggtggtcaggaggacgcccagtgtctgcagcaccttctcacgggcatcatgctcgggcagcgccaggaggtgggccgtgatctcgcaccagccctgttcccacaggcctggcaggaggtgtacctggcgatactgctgcagcttctctggggacatctcctgggtcagctcagcctcctcctcggcgaacatctgccatccgccacagccgcaggccaggtagggtgggggtggggagagaacacacagggagcagttagctcacacctggctagctctgcccttcagacaggaaggcacgaggctgacccctgagggcccacctcttcctctatccccaagtctgtctgtctattcattcattcatccaccaacagaaacacttgtgtggtgccaggtgctgaagaaaccacgatggagacatagtcttaccctcaaggagcttaaggtctagcaggagaataaaaattaactaattcccaaatagcataaatgtaatctaacagtgcagcatggaggcagacaggctggcttcaaattcctgctccaccactgacttgctgaatgaccatggctggcacttagcctccctgagactcatcgtcatcacctcctaagtggagaaactcagcctgtctgtaaagcgcagaagcccagctctatcagcagaacatggtgggagccaatcctgccgggctaccagcagcgggaaagccaacacctgaaccatgacaagcaggcaggttacctgaaggtcagaggtagagggttgggagggggcagagatctcccgtgcagctgtaggaagtgtgcctgtatggagaaagaaggaatgcctgccctaactccaggggagaatgaagcacagggaagatgcacaaggcaagagggaagcccaggagaagaggaggccacagtggaccacctgtgcttcctgcggcagcaggaagtcgtggggctgattggggctggcagaggaaactgaggaggggtgcaatcctgcatcctgggacaggagaggctgagaggtatcccctagtcctttcctacttcacccctcagtcctgccagcttcgcttccaaaacacaccccaattctgtcagctccacctttgtcccttgtgtcctgcgatccagtgcctcctgctctcaccctctcctccagcccccaaaccctcacagcctggcattgcgggtgataaagacaaaatcaatcccttccctgggactgcgaggctctgcaggctctgcccccactgtgcgcggcctggacccactcacacccactcctgtcactctaactctcccctggggcctctggaggcgcagctccgacttccaggtgcacccccgcattggccccattcactccacggctccctgcacacctcaccgccactgaccggcctcccctgactggccttctctgcttatatgctgctgtggtttgagtgtgttccctaaaagttcaagtgttggaagcttaattcccaaggcagcagtattgagaggagctgcctaggtcaggagggcagcgggttccttacgggagagcggttgttattctagagagcaagcccggcccagcatgcttttttccgcaagtgctcttgccctctcaccttccacaatgttgtcatgcaacacaaaggctcccgccagatgcacccacccaatcgtggatttcccagcctcccgaatcatgagccaaaaactgccttttctttatattatccagtcccgggtattctgttaaagcagcagcagacagactacaacacaagctcaggggaattctctgataaacatctgcctgaaagctcagggacgacagggactgcggattattttcccagcacccggcacagcaggcagcacaggcaggcagggtccccctgcggcccttcagctcctcagatgcaccagaggccatggaatccaaaccccaggcaggcatctcaccactgcagaagcccagatgtcagggcatggtctctcagtagaggtcctctcacaggccaaggtacatatgaggactgcctggggcctggcagaccccagcaccctgatgggggtgtcacattgcccatgggaattccacagtccttggctgtcatgacaacatgctgcagtgatccccgagctgcatggcacccctccatcgtggtggacagctcatgtccctccaccttcaggcagctctggacccacccctagcttggctaggtcttcattcttaagcgctgcaagaggctggacttagtgactcacgcctataattccaatactttgggaagctgaggcaggactgcttgagcccaggagttcaagaccagcctgagcaacatagtgagaccctgtctacaaaaaacgaacaaaattaaccaggcatggtggcatggacctgtagtcccagctactcagggggctgaggtgggaggatcacttgagtctgggaggcagagtttacagtgagccaagatcgtgccactgggtgacagagagagaccctgtctcaaaaaaaaaaaaaaaaaagaaaaaagaaaagaaaagaaaaaagaaaaaagaaatcacaagaacagagaagccctgactgcctcagcccaagtacagtgtg

SEQ ID NO: 694 - DNA, 47842 bp, Homo sapiens
cgtgtcagttcatctttctacatttaacatttactgaaggtagcagaagtaacgttttggaagaaaaggatgtttggtaaatcagaacactatttcttgcaataactaaagatcattaataacatttcttccaaacttccccctccccaactccaactccagaaataaccaactagtttgataattactagaagaaaaaaagagaaacaattgtaatatttatacagacataaaggaatggtctggtaaatatggtacaaacaatgaaataaaacacggcaactgagcactatctattatattggtagttaacaaaaagcaaaatacaaaattgcaccttctcaacaccaaaaaaattgcagattttgccattacttttagaatggtaaaaactgcattacttttgcaccaacccaaaacaattatctataataaagtcatgaatatatatattgtcaatttgtcactaataaaattattttggtggtattttgttccatttcttcttacaggggtaattttttctgttatacctcaaatgtaactggcttaaactgatttcttttttcaaccaaatatgtgtctttggaaacaaacattctaatggcatgcctctatacatatctacctagttcaagggaatgcagtttgggagactgtgtgtacatgtgtgcacactcctgtgcgtacatgttaaagtgtaacgtgatccacctgaaatgtacatgcagctgtttatatcatgtagccatccatttcatgataaatatgtttggaaataaatttgtagtactacctcccaacagcaaatcttatttccttttagtttcagtaatagtatttagtattagttgtcactaataaggattatttttaatttgcagatggaaagcttcttcctttccatccataaatcgagtgtttcttctcaaaggcaatggttctcaaactttagtatgcaacagaatcacctgaggagcttttctttttttgagatggagtctcgctctgtcgcccaggctggagggcagtggcgcgatctctgctcactgcaagctccgcctcccgggttcaggccattctcctgcctcaccctcccgagtagctgggactacaggcacccgccaccactcaaaatcctggtccttatctgcaaagattctatttcagtgggcctatgacggagccaagaattctgcatttttaaggcaacttgctgtcctttgagaaacattgcactgaagtatttgggaactttgtttcactgtgatagctgtctgggacttaaatcttccgccaaaggaaaacctggaaaattttgtgattgagcaagcaaatcaagcccatgcgtagtagtagactgggaaccggtgggtgtgagacccaggctctatgtggcctacactcttctgaactcttctgagtcttgattcctggtctgtgaagtgtgcagtgtatccgaattaaatgagaaaatcattccgtgcttttagggtgagtttgaataacttttaggcagtccaccagatggcgatataacttttttttcaaatggagtggttagcctgccgaagttgtgagagtcagtcctacaacattcctagcagatcaagattttatgttcccagttctggcttcagagactgtagcgataacacagggctcatgcagtccaacatcccgtataatacaggttgccagttgttgccttttcagtatttctcctgtgtgatcctggactgcttgtgtcagattcacacaggagcatttgcttacaaatgcagcttccagggccctgcttcagacgtactgaccgagaatctctggaactggttcttcagtatctgctttgcaaaaacaatccgtaagtgctcaacaaacaggttaaagtctgagagccacgtgccagtgaaaaggaggttcacgtcttgctgaagccaccccttattagctgttttgttagaattcctccctcggtgagagtgggattaaggattcagggatgctagttctgccctcttgaggccacactgaagagatcaacttcctttttcttgggaaatgtctgaacattttgaaggtcgctaatcatgacttacctcacctccgcccctatcttctctgggggtggggaagaagtcatactttgcattacaggttggctgtcatcctccttccctttccaggaacactataaccagagactaagagcgaggaccttcactatttcttagctttgtgatcgtgagcaaataacataaactctttgagcctcaatttcctcttctgtaaaatacgagtgaaaataattatacctacttcaaaggattgttatgattattacatggggtgatgaatgcaaagtgaaaaggtaaaatatagcaaaatgtgatctattattaacaataatgagcttcagtttctacatctgtaaaatggtgatgataactactagagcatggggagaattaaatgaggtaatataagtaaggtagttggttaatgtctgacttagaagaggctctcaatagtagtaattataagatggccaataatgtaaaaacaccaatggtctatgcccctaatgatgtgggattttaaaaatcactgaagtaatgagattagcaatttccttactgttatcctgtaggatcagccttagaacaagtataaaacttgtatctcttctatactaagttccttttagaaaatgtttcttaatgaatccacaattatttaataaaacacaaagtattcaatttttaagtattaattcctcacagaaattgctttctaaagttttaagggtgcaaaaaacattaaaaatctttcagtaagctaaaactttaattaggcccttatataattcttgctaaagagagagaatggaactgagactgtgaaatgaaatgacaatgataatatttcctttgaaatttttaaggccaagttgcattaatgcaactttgaaattgttccaatcacacaaggtatttaattaaagcaaatgaaaggctcttcaattcccataaagatttacatggtaggaaaaatgtttctgttttagcaggtctataacatcatttttaaaaattacaaaaattattgtatctacttttaaagctggacagcaatagttatagagagaatcatttaattttagagtcaagcagaccaaattcccatctggctccaccagcgtgttccctttagaaagtaacatttaagagtttcattgcccttgtttgtaaaaaaggggatcatatttgcctccacagtgccgctgaggggtttaaacaaggtgctgaatctagaacacttacagagagcctgtaataagtactcagtgcttaaatgttacctaaaaacaaaggaagatcattagcactaccgtaaaaaattatatatgggtggggcacattggcttgattggtttcgctatatgggtttcaaccaaacgtcttggggaaaaattcggaaggcaataaaaggaaagtggaaaggacaaagaggattggagttggggagggtaagagacagttataagtctgaggaaaaattaggaaatagcatagaattctaattcaaataacttaattacccttgtatttatattttttcttaaagttgttttactttagtgagcagtctttcttctcagattgtgtcttagcatattaatgaaaaaaacagatgataatattactgtacaataagagtttagcagtgattgaaattcagtgtcaatgaagacacagggcaatggagagaaaaatcatagatatgtcatgaaaacagttttagtaatttttcatttcaacaacaaatttcataataatgatataagtacattctttattttatatatatatatgttctttttatagagatggggtctcactgtgttgaccaggctggtcttgaactcctggtctcaagcaatcctcccatcttggcctcccaaagtgctgggattacagatgcgaaccaccatgcctggcctctgaattttaaaatagttatgagtgcctttagaatttctactattggagccctttatgcttctatttaccttcaatcaagatttgcacctcagaaaacatagttacttgttgttgttgttgttgttgttaggaaaagttcagtatgaatgctgttgtctcattctacatagcaattgtttgggtcatgtataataaagaattgatacctactctaaaaatgaagatattttgtgttctaggaattgagtggcacttggtcaaagaatgatttatggaatctctgggcataaggggaattgattgctctttagtttttcttttccacacttagtactaaattattttgaatttatgggaagttaagctaagtgaaccacatctttccattttgttgcaaggagcttatcactttctaaacggagaactatactgtctcggagtaatggattgaatagtggcccccccaaaattatgtccacttcctaaatcgcagaacctgtgaatgttactttgaaaaaaaaagggggtctttgtagatgtcattaagttaaggatctccagatggggaggtgatcctggattatctgagtgggttctaacccagtgacaagagtccttataaaagacacacgaaggactgacacacagagatgagaaagaggcaatgtaaccatggagacagagactggagtgatgtgccacaaatcaaggcaagtttgtagccaccagaagacggaagaggtaagaagtacatcatcccctggcctccagaggagtgtggccctgctaacactctgattttggactcctggcatccaactgcgtgagtataaatttctgttgttttaagccaccaagtttgtggtcatttgttacagcggccacaggaagctaatacacagggtaagctgataggggaatgagagagttttttcacagttgcatgaatgggttaagaattctaaagaataattagccaggtgtggtggtggatgcctgtaatcccagctactcgagaggctgggaggcaggagaatcactggaacccgagaggcggaggttgcagtgagccaagatggcgccactacactctagcctgggcgacagagggcgactctgtctcaaaaaaaaaaaaaaaaagttatttgaaagaataaacattattgggtaaggggagatgacatggtagccattagaaagaggggtggggggagtgaggaaaaaaggcaaaaaacagagaccaggaaggtgaataaccagaatgtgagctaaggagatggaataggaaggacactgtacccaggcagagtatggactgaggagaaaaataaatgatatccctaaatatgttttaatttcagggagttactttgtcttctcatattttactcagatcgctttgtgtgtgtgtgcgtgcgtgtgtgtgtgtgtgtgtgtgtgatgaaatacatattttaattaaatattttacctcagaaacagcctctcagagaatgtttttggataaaatgcaatgttttggtaatattctcttcagaaacattaagttaggatgttagggtgatggaaaaacctcaataaaaaccagtagcttaagtatggagacactcagaactcagtcatcacattgggaagaaaatgagatagtggaaaagaagaaaaagtcacccaggaaagagcccgagaaaacttctaagagtcggagtttttcactgatgcttaccaaagcttagctgtatggaataatggaggaatacatccttttaactttagtcaagctttttaaattctgaaaaggggactctttcacttagagtgctgcagtacaaggaaagcaattgtttggagaaaataggctatgcattctgaaaaaaaatatttctttttggcaagggctatggattcctgtcaatctaaagggatctctaaacttagggagagggtaggaagtagctctgccctctgagaggctctattttattctgaaaggccgaatgtgacaaaagcagctttaatgatcagacagagctgaggtatccaaagctacatataaaatagaagcttaggacacctgaaaaaacagacaagaattaacacaatagcaaacaaaatggcagactcaatcactgcacctggccgaaatatttctatgaagtcagagtttagctgggtaccagagcaattttctccctaaaattgggtaatgaaaatttgaacagaagaggtggtatgtgctgattaattttatgtgttaacttgactgggctgaaggatgcccagatagctggtaaaacattatttctggatgtatctgtgaagatgtttccagaagaggttagtatttgaattggtaggctgagtaaagtagattactctcaccaatgtggtggttagagagtccatcaaccaacccagtgaggactcgaatagaagaaaaaggtggaggaaaggcaaatttgttctcttttcttgagctggcacatccatcttctcccatccttggatgacagaatttctggttctctgatcttcacacttgggctaaattacccactggctttccaaattctccaacttgcagatagcaggttgcagagcttctcagcctctgtaatcacatgagctaattcccataattaatctctgtctctgtctctctctttttctttcacttaataaatatggagatttattgaagaaccaagaggatataccactggttctgtttctctggtgaatcttaatacataaggttaaaatagattaacattagaagcgaaaagtgaaaatgcctcaaaatatattttaaaacttctacttcaaactatagaaaacacgatttcttggtcatcaaatcatggaagaacatctcattcttggaatatgttgaggtatatgagaaatcttctcattgcttctcagaattcttagcacctgcaaaaccattattttgtttatataatcttacagaaatgttacccaactactagattcacgtgaaataattttttcttttgatagaaaaccagcgaggtcagtaatttctgtcgggagaaagagcaggagaaacaattctccttacatgaattcttaggtgtccagttgaaaacattccagaagagggggtggaccatggatggtgggaagcacaaacttcagagccagatccccaaagtttggtgaaaaggccaggaaaagcaccaaataaacacacagccatgcagcccttaacaagtctactttgtaaaagcaattttgttaatctctttcttcaggaaacactttttcttgtggcggtatttactttgttaaacgaagaaagttccctgccttctctctctccagttagggctaaaacctggacactgacagagctaatgtatgtttgatctaatcagtcaagatcaagtgggggaaagcaataaaaataaatttcaaaatgttctctatcaaaaatttttcaagaaaaatgttctaattaagaatctccctcaagtatgtttctgtacaattggaccagtgaactgggactggaagtgtcaagagggttgtagaaatgaaagtattgcctcattttctgatttttgttcccacctacaggagctcccacagtgttctactctttccattttagggagaagatgtagagcagtacaacttttttccctctatgacatgtcccagacctttccgaactctttagtgcctctgattattagtaaacaattcaagcttactgatggagactgtaactttgatgtcatttttcttctccttggtttacagccaggaatcattgcatgtcttccaggtattggcaggaacacatacatttcccaagcatataggtgggattagtataaaataaacttatgaggcctttcatattttatgttgcctcagaccaggtaagttttgtcttaattttctgattatcctgagatgtttctccatttactccattgaatctacttgactctgagttctttttttctttattcttctctattcttattctttttttttaaattcttgatggtgataatatctcttcgcttcaagtgataatgttcattccttaccctgttagatatttttaatataattcttataaacttcttaattttctcaaaggcccatgcctctatgataatgatcagcacttgtttaatttgaaaatgtcaggcatatgtaagaggttcaattgcccaggagctcataactccttactcattcattaaaaacaaatcatcgggatgctcctgctctaatgtttagagcctttcttttaacaaatggcctcttaattttcatggtagaaaagacttttttttccttctgtgatacagaacagttttcaattatttagtcgtcatgagctgaagcagggtagccgtagatatgctagactatttttctacaataaccccagcatgtcctttatttaggagaaattttgactgatggtggaaagaaatttaaagtactcctgcattaaatgaagttatgattcatactaacagtgaaaatgattatttgaatctcagaaggcatacatttctaaaacaatgtttgttttgattatcttctaagagaatatcgagatttacaaaatttattctttctttcatttcattgtatcatccttttcctatgtgaacaatctcacatggcttttccttctttcagagtggatttggtattttttctctttcatttgtatgctttccatttactttgtatttaaagacaatctcaaacttgtaaaaagttacaagtacagtaaaagaactttcttttgaaattttttgagtgtagttgctaacatgctcattcaacttacctgactacttctatgtattccactacaaacaagaatgtttcctacaaacattcttctacataaccatattaccatcaaagtcagcaaattaacagtgataggttactaccatataatcctcaaattctttcaagtttcctcaattttctcaatgatgtccttcatagcaaagggatccagttcagcgtcatgtgtttcattttgttgtcatatctgtttggttttcttcaatgtggaacagttccctagtctttcttggcctttatgaccttaacacttttgaagattacaggccaattattttgtagaatagctctcaatttgagttcacctaatgttttcttatgaatagatttaggtttgcatctttgataggaatatcatagcaatggtgacaattttgattcacctcattactggtgatgttaactttggtcactgattggtgtctgctagacttctccactgtaaagttactctttcttccctttgtaattaataaatattttgtaaggtggtactttgagactatgcaaatatcctgttcctcatcagactttcaatttgtccattcatttatttatttcagtgtggactcatgggttcctattttattcagtaggttaaaaccagttgctttcattatttagtttgatgctcagtgtgggggttcaataaggctggtgggaaaaatattaaagatagttatagtaatagccacaaactctcttggaaggcctgagagtttgtataacatcagtaatagatctggctgaaggcggcctggtccctttacctttagttaaataagttaaagtagtaactaaggaatgtggggaagttatctagctagcttgtttactcatgtggtcttaagactaacctttgatgtacggcaggtgcttaattgctttctacttgggaattccacagtgtcaattaccctctagtggtgttgactcaagcctttgtcaattaatcttccccaaataaatgtgagtctcactagctggtcagggccacagtcacaactgtttacagtactctccagggagtctgtaagtggcttggacactcagctggactggcaaagcagaatatctgtgtgtcagtgtacttcattcatccatggctggctcagggtctgcgggtcagaccgccccaagtgagaactctttcaagagtctttttgatatgttctcataagtctttcagtgcttctttacttcctggcaaagatgtcccaggctcatcttatagtttccctgccctagacttgggatcagccatttctccaaggagacttggatcctgttttggagtatggtcttcagaaaagatgtcagaaccaggtgtgctcattgttactgagggcttgttacttcctgttttcaatggacagagctagttaatatatatatatacttatatacatacataagcacatttttacacctatacttctatatccctattgaaaaccatgggttcactttgatatctccaattccaatctaacagcacagggctcattcatgttttctctccttctatatttgaaacttccttctccaatagtgagaagtcttgatatatttttgatcaagccttctgtatgtcaccagtctgtcattgctgctgcatcccacactccctgtgcaatgctttccctacctgcttgggcttcaatatcccacaccaggcttctcctctcgttgatgttcttcttgctctacttgagctccattacccctaactagtccagcatcctcaccttgcctgggctttagcactctgatttgggtaaccacaggattccccctatccttgccatattcatttctcttgccacttagtggcctttggattgatctgaacaaggaaaggataaaagagaagttatcattttattttcaagttagtatttgctgagtactatttatcaagctctgtattatctcattttagtgacataatgaacttgattacattttactaattgaagcagtcaagatgaaagaagttgtcacttgccagactccacagccagtaagtggcagatccaggactggatgttgtcttgctgactataaaccaatgttccacttggaagctgtgtatgtgtgattcatagaaaaagtggttaattttcaaaggcaataatcatagaattggtagtgtataaattttttggggatataattgtcagatgtctcaattacaagcccaagatagatgaggcagtattaatttgctaattacatattttgaaaagattgtacataaagaaaatgttttctctttaattacggcattaaggatttcaaaaggtactttataatttataccatttcatttcataattttatttcttttctctgtgttttaaagcatgttctaagggttaaacttttaaactttaaactacacagtgaatcactttcttttcttttctttttttttatttttttgagatggagactcagtctgtctcccaggctggagtgcaatggtgcaatctcagctcactgtgacctttgcctcccaggttcaagcgattctcctgtctcagcctcctgagtagctgggattacaaacatgctccactacacctggctaatttttgtatttttagtagagacagcgtttcacagtcttggtcaggctggtctcgaactcctgacctcaggtgatccacccgccttggccttccaaaatgctgggattacaggcatgagccaccgcgcctggcctgtgaatcactttcaataagcctttccataatttagaaaaagacatataagaaggaagatttcttacgctgtttgccttttgttaaataatggtgacccagtttctaaaaggaaccagtttctaaaaggaaaacctgagtaattacttagaagaggctggctttctaaacttagttaacagctattattatttaattgtcagttttacagtaacttggtaagtttcctgcttaatctaactactctaaattgtactaaaaaacctaccctgttccctgcattgtatttttcatgtctttacaagcttgcactgaggccttaccttcctacattattggccagcttatgtaatgcccatgccaggcaaccaccatttgctttctacaaggtgtctcatttaaatttcagaactacattcttattctgtagttccattgttactccaattttataggtgaaaaaactgaaactcagtggggtaaagtaacttgaccaaaatcacatttctaggataacaatggcttcttctgcaataccttctgaaggacctacctgaggctgttttacagttaacttttttaaataagataaatagttgggacttaattaaactaaagggcttttgcatggcaaaaggaacagtcagcagggtaaacagacaacccacagagtgggagaaaatcttcacaatctatacatctgacaaaggactaatatccggaatctacaacaaactcaaacaaaccagtaagaaaaaaaaatcccatcaaaaagtgggcaaaggacatgaatagacaattctcaaaagaagatatacaaatggtcaatgaacatacatgaaaaaatgctcagcatcactaatgatcagggaaatgcaaatcaaaaccacaatgtgataccaccttactcctgcaagaatggccataatcaaaatattaaaaaatggccaggcatggtggcttatgcctgtaatcccagcactttgggaggccgaggcagatcacctgaggtcgggagtttgagaccagcctggccaacatggtgaaaccctgtctctactgcaaatacaaaaattagcctggcgtggtggcaggtgcctgtaatcccagctactcgggaggctgagggaggagaatcatatgaacctgggaggccaaggttgcggtgagccgagatcgtgctattgcactacagcctgggggacaagagcgagacttcgtctcaaaaaaaaaaaaaattaaaaaacagtagatgttggcatggatgtggtgatcagggaacacttccacactgctggtgggaatgtaaactagcacagccactatggaaaacaccgtggagattccttaaagaactaaaagtagaactaccatttaatccagcaatcacactactgggtatctatccagaggaattgaagtcattatatgaaaaagatacttgcacatgcatgtttgtaacagtacaatttgcaattgtgaaatcatggaactaacccaaatgcccgtcaatgagtggaaaaagaaactgtgtgtgtgtgtgtgtgtgtgtgtgtgtgtgtgtatatatatatatatatatatatatatatatatatatatatatatatgatggaatactactcagccataaaaaggaatgaattaatggcatttgcagtgacctggatgtgattggagactattattctaagtgatgtaactcaggaatggaaaaccaaacatcatatgttctcactgatatgtgagagctaagctatgaagacgcaaaggcataagaatgatacaatggactttggggacttggggggaagggtgtgaggggagtgagggataaaagactacaaatagggtacagcatatactgcttgggttatgagtgctccaaaatctcacaaatcaccactaaagaacttactgatataactaaataccacctgtactccaataacttatggaaaaacaaaatatttttttttttgagatgcagtctcactctgtcgcccaggctggagtgcagtggtgtgatattggctcactgcaagctctgcctcccaggttcacaccattctcctgcctcagcctcccaagtagctgggactacaggcgcccaccaccatgcctggctaattttttgcatttttagtagagatggggtttcactgtgttagtcaggatggtcttgatctcccggcctcatgattcacatgccttggcctcccaaagtgctgacattacaggcgtgagccaccgtgcccggcccaaaaaaattttttaaaaaaagatcagtaagatcttatacaaaaatagtggacatgaaaacactataaatcaattgaacataaaagatgtatacagaacgctctaccccaaaacaacataatatacatttttatcaaagcacatagaacattccccaggacagaccatatgttaagtcacaaaataattttaataaatttttaaaggattaaaatcatacaaagtattttatctgaccacaaggaatgaaattagaagtaaaaaatagaaagaaattggaaaatttgcaaatacataaaaattaaacagcacattttacaacaaccaatatgttaaacaagaaatcgcaagataaattagaaaatacttagagatgaatgaaaataaaaatacaaactaataaaacttatagggtgcagttaatgcagtactcagagggaaattatagctgtaaacccatacattaaaaaatgaagatggatctcaagttaataatataacttataatgtaacttaaagaactaaaaaaagaacaaactaaagcaaacctaacagaaggaaggaaataattaagattagattagtgataaataaaatagagaatagaaaagcaattgagggagttaatggaaacaaaagttggctctttgaaaagatcaacaaaattgacaaacttttaaagctggaccaattttaaaaagagagaagactcaagttactaaaataagaagttaaatgaaggcattttcctggacacacaaaaagaaaatggattaaaagagaatactatggacaattgtataccaacacattagaaaacctggatgaaatgggcaagaaacacacaaaccctgaaatctgactcaagaagaaatggaaaatctgaacatatctgtaaaagtggatatgtttacaccttctaaacactttacttcttctaaaaagacagaatcagtaatcagaagcctcccgacaaagaaaagcccaagaccagatggtctcattggtgatttctgcctaacatttgcagaagaatgaacaccaatccctttcaaactcttcaagagatagaaggggagaaaacactttctaaccgattttttgaggccaacattaccctgatatgaaagccagacaaagacacctcaagacaagaaaaccacaaaccaacattccctatgaaaacatatgcaaaaatagtcaatgtatactagtaaaccaaatcaagtaacataccaaaaaggctatacactatgattaagttgaatatatcacaggaatacaagggtggctcaccttatggacattattcaatgtaatacaccaccgtaacaagatgaaggtgaaaatgaatgaccatcttgatttatgcaaagtatttgacaatcacaagaatgacaagaatactcaacaaattagaaatagaatggaacttacttaacatgatgtagagacctaattagagaaaaggagtcaggctggcaggaccaagggaaagcaaaaagatagaacaaataaactataaatatggctttcttcatagttatataaacaaaagaggaattaaatgaattataggtctgtttttctttatggcccaagacatatagccctcctgaacaaataaaatacataacttacaaacttcctgcttgccataaaatgcctcaatttatcaaacatcctggctgacagaagaatgcaagtttccaagttccatcctataaaatctccagcaagcctttgtttctttgcagtcagctcctcttctgctggcttgcacattgcctcctcacaacatgttttcatactttctttaataaatctgcctttctttacctacaattgtcttggtaaattcttttatctctacaccaccaacccagatagtcatcactcacctacaacacatgataaacggcatttagggaaaacacatagctacatcatactccatgaagaatgaataaaagctttcccctaagtataggaaaaatacacgatgcctgcttttgtcccttctattcagtactgaaagttctggctagaacaattatgcaagaaaaaaacaaacgaataaaacagatccaaattataaaggaaggagtaaaactatttgcagatcatatgatcctatagataggaaatcttaaaagatatacacacacaaactattagagctaataaattcaggaaagtattgagtatataactagcacttaaaacttagttttgtcaacatgctgttcgctatgttaaaaaaaaagattagttttgtttctactcatagcaatgaataatccaaaactaaattaagaaaataatttcagaagggtggagcaagatggcacaatagaaaactccactgattgtccctcaatgctagcacaccaagctgtctacacagacaaaacaccttcataagaatgaaaaatcaagtgaccactcatagtacctggttttaaattcatattgctgaaagaagcactgaagaggttaaaaaaaaaaaaaagccctgaatcgcagacaccacccctcccttacccctggcagcagcagtgggcatctctgggtactgggggagggagaacacaccaactgtgaagcattgaaagtgctgttctattagagcagaaaggaaacccagaccaaactcaactgacctgcctgcaaagggagggacccagtgatctaaacttgagttcctgcaaacctcaccaccacgggctacagcaccgtgtgtctccaagtaaacttgaaaggcagtctaggcgataaggattgcaacttgtaggtgagtcctggggctgaattaggcccagagacagtggactagggggacacgtgacatactgagacaccggccgggtcagctaaggaagtactggcatcacccttcccctaaccccaggctgcacagcttgtggcttcaaagagaacccctgtcttctgtttgaggagaacagagggaagagtagggagaactttgtcttgcatctaggatcccagcccagccacagcaggatagggcactggtcagaattgtgaggcccctattccaggccctggttcccagacaacttttctagatatgctctgggccagaagataactggcagccttgaaggaaaggacccagtactgctaccattaatcacttgctaatcaaagagcccttgtgccctaaaaaaccagcagcaatatctaggtactacatccagggccttgggtgaacttctgagatttgatgacttcaggtgagactcaggacataaccagctatggtggctatgtgaccaaactccttccacttgagaaaagcagagggaaaagtaaagaagactttgtcttacatcttagatactagtatggtcacagttgtgtagagcaccaagcaggctcttggggtcctcaatcccaggacttgactcttggatgacatttctggacctgccctgggccagagcggtacccactgccctgaaagatgagtccctggccaggcagcattcaccacaagcttgcttaaaataccttgggccttaacagaacaccgtggtagtctggcagtattcttcatggcctggggtggcagtagctatggtgaggctcctcttcctttggaaaggggagggaagagtgggaagaaatgcattgtgtggtttgagtgccagctcagctgaatgcaacagaacaccatgtagacttctaaggtttttgactctagtccctgactcccaggtggcacttctgaacccacctggggcttgggggaccttgctgctctgaagagaaggacacaggcctgactggctttaccacctgctgattgtagagccccagggccttgagtaaacataagaagtagccagggaaaagttacagtgggccttgggcaagaaccagctctgttctggcttcaggtttgacccggtgcagtcatagtggtggtggccacaggggtgcttgtgtcactccgtccaaatctttaggtggctcagaacagagagagagactctgtatgtttgagataaagtaagggaagggaacaagggtctctgccttgttcccttttctagaattttctctagccagaaaattctcctagatcttgttcaagattagcaagatggtacctctgcaatactgcaagaaccacagcattactgggcttgggttgcccactaaagcagatacagcttagatcacaaaacccaagtcctttcaaatatctgaaaagccttcgcaagaaggatggctacaaataagcttagacagtgaagactacaataaatacctaatcattcaatgcaagactttgaagaacatctactagcatcgatgccatccaggaaaatgtgacctaaccaaataaggcactaggaccaatcctggagaaacatatatgtgacctttcagacagagaattcaaaatagctatgttgaagaaactcaaagaaattcaagataacaccaagaaggaattcagaattctatcagataaatttaacaaagagattgaaataattaaaaagaaccaagcagaaattctggagttgaaaaatgcaaactactaaagaatacattaaagtcctttaatggcagaattgaacaagcagaagaaagaattagtgagcttgaagacaggctaattgaaaacacatagaggagacaaaacaagattctaaaagcagcaggataaaagaaagaaataacatacaatggagctccaatacatatggcagcaggcttttaagtggaaaccttagaggccaggagaaagaggcatgacatatttaacgtgatgaaggaagaaaactttcagcctagaatagtattatccagtgaaaatgtccttcaaacatgaagaataaagactttcccagacaaacaaaagctgaggaatttcatcaataccagacttctcctacaagaaatgctaaagggagtacttcaatccaaaagaaaaggaagttaaaaagcaataagtaatcacctgaaggtaccaaacccatggataatagtaagtacacagaaacacagaatattataacactgtaactgtggtgtgtaaactacccttatcctaagtagaaagactaaatgatgaactaaagactaaagaaatcaataaaaaataacaactacaataactcttcaagacatagtcaatacaaggtataaatagagacaaaaaaactgttaaaaagcaggtggatgaagttaaggcatagagttcgtattagttttctttttgcttatttgtgtatacaaatagtgttaagttgttatcacattaaaataatgggttataagatagtatttgttggccgggcacagtggctcatgcctgtaatcccagcactttgggaggccaaggcaggcagatcacaaggtcaggagattaagaccatcccggctaacacggtgaaacctcgtctctgctaaaaatacaaaaaattagccaggtgtggtggcatatgcctgtagttccagctactcgggaggctgaggcaggagaatcgcttgaacccaggaggcagaggttgcagtgagccaagattgagccactgcactccagcctgggtgacagagtgagactccacctcaaaaaaaaaaaaaaaaatagtatttgtgaccttcatggtaatctcaaaccaaaaaaacatgcaatggatgcacaaaaaataaaaagcaagaaactaagtcttatcaccagagaaaatcaccttcactagaggaagacaggaaggaaagaaagaaggaagaaatgaccacaaaacaactaggaaacaaataacaaaatagcaggagtaagtattcacttcttaatgacaacattgaatgtaaatggactaaactctccaatcgaaagacatagactggctgaatgaataaaaaaaaagatctattgatctgctgcctataagaaacacacttcacctataaagacacacataggctgaaaataaagggacagaaaaagatatttcatgccaatggaaaccaaaaaagagcaggagtcactatatttgtatcagatgaaatagattttaatcaaaaactataagaagagacaaagaggttactatgtaacaataaagtggtgtattagtccgttttcatgttgctgataaggacatacctgagactgggaagaaaaagaggtttaattggatttacagttccacatggctaaggagccctcagaatcatggtgggaggtgaaagacacttcttacatggtggcagcaagagaaaaatgaggaagaaacaaaagcagaaacccctgataaacccatcagatctcatgagacttatccattatcatgagaatagcatgggaaagactggcccccatgattcaattacctcccccgggtctctcccacaacatgtgggaattctgggagatacaattcaaattgagatttgggtggggacacagccaaaccatataattccacccctggcccctccaaatctcacatcctaacatttcaaaaccaatcataccttcccaacagtcccctaaagtcttaactcatttcagcattaacccaaaagtccacagtcggaagactcatctgagacatggcaagtcccttccaccaatgagcctgtaaaatcacaagcaagctttacttcctggatacaatgggggtattgggtaaatacagccattccaaatgggagaagttggccaaaacaaaggggttacggggcccatgaagtctgaaatccagagaggcagtcaaattgtaaagctccaaaatgatctcctttgactccaggtctcacatccaggttacgctgatgcaagagatgggttcccatggtcttggacagctctgcccctgtggctttgcagggtagagccttccttcaggctgctttcatgggctggcattgagtgtctgaggcttttccaggtgcacggtgcaagctgtcggttgatctaccattctgggttctggagaacagtggccctcttcttacacctccactaggcagtgccccagtagagactgtgtgtgggggctccaaccccacatttcccttctgcactgccctagcagaggttctccatgagggccctacccctgtagcacacttttgcctgtgcatccaggtgtttccattcatcttctgaaatctaggtggaggttcccaaacctcaattcttgacttctgtgcacccacatgctcaacaccatgtggaagctgcctaggcttggggcttccaccctctgaagccacagcccgagctgtatattggcccctttaagccacagctagagcagctgggacaagtggaccaagtccctaggctgcacacaacctggagaccctgggcctggcccatgaaaccattatttcttcctgggcctctgggcctgtgatgggaggggcgccatgaaggtctctgacatggcctggagacattttccccatggtcttggggattaacattagactccctgatacttatgcaaatttctgcagccagcttgaatttctccccagaaaaatgggtttttcttttctatcacttagtcaggctgcaaattttccaaacattaatgctcttctttctttataaatctgaatgtctttaacggtacccaagttaccgcttgaaggctttgctgcttagaaatttcttctaccagttaccctaaatcatccttctcaagttaaagttccacaaatctctagggcagaggcaaaatgctgccagtctctttgctaaaacataacaagagtcacctttgctccagttctcaaaaagttcctcagctccatatgagaccacctcagcctggacctcatagtccatatcattatcagcattttaggcaaagccattcaacaagtctctaggaagtttcaaactttcccacattctcctatcttcttttgagccctccaaactgttccaacctctgtctgtaatcccagcacgggcaaatttcttactgtctgtgagactcacttaaaattataataggtgtacccaactaataaacgaagtcatttgatcttatgagtaagcaatgatatggggagagctcaacttctcttttgcttctttttcataaccactctttgttgtctatgctggacatatatttagcatgaagaaggatatccagtagtcctttcttatccacagggaatatgttgcaaaacctccagtggatgcttcaaactttggatagtactgaactcaatcgttgtcaattggaacattttctgtcgatgtcttccacccgcaaatttaatgccttttccatcttaactaagcacttatcacacactgtggatgtaacttttacagtttgagatgtgagcaaaactagcaaaattttttttccttcagcgtttaatggatagaagattcattcttactgtagatattagcaacctagtatatgacttttccccttattaagtcaagaattttcaccttttcacttaaaggaagcactttacaacttctctttggtgtatctgaattgccagcatcactcttcttgaactttggggccattattaagtaaagtaagagttacttgaatataagcgtgtggtattatgatacatctgataatgaaggcagctactaagtgactaacaggcaggtactgtctatagtgtggatatcctgaacaaaggaataatttacgtcctgagtgggatgaagtggtgcaagatttaatcacccaattcagaatgatgtgcaattcaaaatttatgaattgtttatttctggaattttccatttattattttcagattgcagttggctgtggataaccgaaactgcagaaagtgaagctgtggataagggacggacaacagtgcatcacattaacagaatgaaaaacaaaaaccatataatcatcttggtacatgcagaaaaaacatttgataaaattcaacctccctttatgatttaaaaaaccaacaaattaagtatacaaagaatataactcaaggaaataaagtccatatatgaaaaacctacagctaacatcatattcaatgttgaaaagctgaaagttttttctcagtatcagaaacaagacaaagatgcccactcttaactcttctattcaacatattcctgcaagttcctagccagaccaattaggaaaaaaaaagtcatgtaaataacatttgacccagccatccccttattgggtatatacccaaaggaatataaatcatgctgctgtaaagacacctgcacacatatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaactgaacaatgagaacacttggacacaggaaggggaacatcacacactggggcctgttgtggggtggggggaggggggagggatagcattaggagatatacccaatgtaaatgacaagttaatgggtgcagcacaccaacatggcacatatgtacacatgtaacaaacctgcatgttgtgtacatgtaccctagaacttagagtataattatatatatatatatatatataaagaaaagtaagaagtgaaattgtctctctttgctgatggcatgatcttctatatacaaaaccctaaagactccaccaaaaaactggtagaattagtaaacaaattcagtaaagttgtaggatacaaaatcaacacagaaaaattaggagcatttctatatactaacagtgacctatctgaaaaggaaatttaaaaaaattccatttacagtagtatcaaaagaataaaaacaattttatttaaaatttagaagtaaattttttaaaatttaggaataaatttaataatttaataatagaagataaaacttagaaataaatctaactaagagggtgaaatatctgtacactggaaattatgaaacattgatgaaagaaattgaaaagacacaaataaatggaaacatataccagttcacgggttggaagaattaatattgttaaaatgtccatactacccaaagtgatctacagattcaatgcaatctctacaaaatttcaatgttatttttcacattagaggtagaaacaatccaaaaatttatatgaaactaccaaagacactgcctgaatagccaaagcaatcttgaacagaaagaacaacatttgaggcattatgctacctgacttcaaaatatattacaaagctatagtaattaaaacagcatagtattgtcacacagacagacacacaaaccaatgagacagaataaataatagaattaaacccatgcatttatggtcacttgatttttgacaaaggtatcaagaaaatacaatggggataagacactcttcaataaatggtgttggaaaaactggatatccacatgcagaataatgaaattggacatttatctcacaccctgtatgcaaatcaactgaaattagattaaatacttaaatgtaagacccgaaactgtaatagtcccagaagaaaacataggggaaacgctccatgactttgttctgggcaatgattttttagatataacccctaaagcacaggcaacagaaacaaaaatacacaaatgggactgtatcaaactaaaaagcttctgcacagcataggaagcaagtaatagagtaaagagataacctacagaatggaagaaaatatttgcaacatacatctgaaaaggggttaatatccaaaatatataaagtactcaaagttcaataataagaaaataagtaatccaattttaaaagggcccaaatagatgtttctcaaaagaagacatataattgggcaacaggtatatgaaaaaatgttcaacatcaataattatcagcaaaatgcaaaataaaaccaaaatgagacaccatctcaaatctgttaggatggttattataaaaaagacaagaggtaacaagttttggtgaggatgtgaacaaaaaaccccttgtatgctgctggtgggaatgtaaattagtacagccattatggaagacaccatggaggttcctcagaaaactatatgatccagcaatcccacttctgggcatatccaaaggaactgaaatcaggatcaaagaaacatctgcactcccatgttcatttcagcattattcacaatagccaagctatggaagcaacccaagtgtccatcagtagatgaatgtataaagaaaccatggtatgcatacccaatggaatactatttggccagaagaaagaatgaaatcaagtcatctgcagcaacatggatggaactgaaggttatcatgttaagtgaaataagccagactcagaaagacaactattgcatgacctcacctatatatggaatataaaaaaataaaactcatgaaagtaaagagtagaatagaagtcaccagaggatgaggggaaatacggagtcgttcatcaaaaggtacaaaatttctgttagacaggaagaacaagttttgaagatctattgcacagcacaatgaccatagttaataatgtaatgtatatttcaaaattgctaagagagattttatgagctcataccacaaatgttaaatatgtgatgaatatgttaattttagcttgatttaattattccataatgtatacacatatcaaaacatcactttgtatgtcataaatatataccattgttttttgtcaagtatttataaaaaaacttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctctttgcagactaactaaaagccaccatatctaagtagcatttgatgagaagaaactagttatttatgtaaaccaaaataattaatgttacaacggagaaactttatatagcagccacagatgaagcctggcatgaggaagtcaatgatcagttgctgctctcgccatatggtgggttataaaatcttcccaagacaagtgaggcaccgagaaattgaagactcatatacattccagagaacagggcctctctcatccatctcctccattagggcctttcttcatatttcatagatagacagctggagccagttctctgcttcctgggccctctaaaagggccaaagacttggacaaatccattgtcctgggcactcaggaggcaagattctgtgtgtgcatgagtgtacgaacatgtgtcatgtgagagagtgtgtgggcactgggcacacgaagcatgagggtaggtgagtgaacatgtgtcagcctacatgagtgtatatatatgtgcacagagtgtgtgagcatgtgtgcatcaaacataagtttgtgtgaacgtggcaccacgagtgaatttgtgtgtttgtgtgtggggtaagtgaacatgttgcagcctgagtgagcaagtgtagtgtgtgcaacagggatgtatgtattcatgtttacacatgtcagcttaagtatgttagggtgtgtgaacgtgtgtcagtgtgagtatgtgtgggcctgtgcacagaatgcaagtaagtgtatgtgtgcatgccgagggtgagtgagagtgtgtgtgtgggggggtaagtaaacatggctgggcatgggtgagtgtgcacaccaggtatgagtggctgtgtgcagtgttgtgtgtgttcacaatgagtgtgtgaaacagacctgccaggccatgctagtgagaggtgacagcatgctggcagccctcgcagccctcgctggctctcggagcctcctcagccttggcgcccactctagtggcacttgaggagcccttcagcccgccgctgcactgtgggagcccctttctgggctggccaaggccggagctggctccctcagcttgtggggaggtgtggagggagaggcacgggcagcaactggggctgcgggcgtcgcttgcgggccagcacgagttccgggtgggcgtgggctcagcgggcccgcgctcagagcagccatccggccccgatggcccctggcagtgaggggcttagcacctgggccagcagctgctgtgctggatttctccccggccttagctgcctccccgcagggcagggcttgggacctgcagcccgccatgcctgagcctctctcccctgccccactccgtgggctcctgcacagcccgagcctcccctatgagcgccgctccctgctccacggcgcccagtcccatccactgcccaagggctgaagagtgcaggcgcatggccggggactgccaggcagcttcacctgcggcctggtgcaggatccactgggtgaagccagctgggctcctgagtctggtggggacttggacaacatttatgtctagctaagggattgtaaatacaccaatcagcactctgtatctagctcaaggtttgtaaacacaccaatcagcaccctgtgtctagctcagggtttgcgaacacaccaatcgaccctctgtatctagctaatctagtggggacatggagaacttttgtgtctagctcaggaattgtaaatgcaccaatcagcaccctgtgtctagctcagggtttgtggatgcaccaatcagcactctgagcctagctaatctggtggggacttggagaatctttatgtctagctaagggattgtgaatgcaccaattggcactctatatctagctcaaggtttgtaaacacaccaatcagcaccctgtgtctagctcaaggtttgcaaatgcaccaatctatactctgtatctagctaatctagtggggaggtggagaacttttgtgtctagctcagggattgtaaacacaccaatcagcaccctgtcaaaatggaccaatcagctctctgtaaaacagaccaatcggctctctgtaaaatggaccaatcagcaggatgtgggtgggccagataagagaataaaagcaggctgcccgaaccagcagtggtaacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctcc

SEQ ID NO: 695 - DNA, 15986 bp, Homo sapiens
ggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctctttgcagactaactaaaagccaccatatctaagtagcatttgatgagaagaaactagttatttatgtaaaccaaaataattaatgttacaacggagaaactttatatagcagccacagatgaagcctggcatgaggaagtcaatgatcagttgctgctctcgccatatggtgggttataaaatcttcccaagacaagtgaggcaccgagaaattgaagactcatatacattccagagaacagggcctctctcatccatctcctccattagggcctttcttcatatttcatagatagacagctggagccagttctctgcttcctgggccctctaaaagggccaaagacttggacaaatccattgtcctgggcactcaggaggcaagattctgtgtgtgcatgagtgtacgaacatgtgtcatgtgagagagtgtgtgggcactgggcacacgaagcatgagggtaggtgagtgaacatgtgtcagcctacatgagtgtatatatatgtgcacagagtgtgtgagcatgtgtgcatcaaacataagtttgtgtgaacgtggcaccacgagtgaatttgtgtgtttgtgtgtggggtaagtgaacatgttgcagcctgagtgagcaagtgtagtgtgtgcaacagggatgtatgtattcatgtttacacatgtcagcttaagtatgttagggtgtgtgaacgtgtgtcagtgtgagtatgtgtgggcctgtgcacagaatgcaagtaagtgtatgtgtgcatgccgagggtgagtgagagtgtgtgtgtgggggggtaagtaaacatggctgggcatgggtgagtgtgcacaccaggtatgagtggctgtgtgcagtgttgtgtgtgttcacaatgagtgtgtgaaacagacctgccaggccatgctagtgagaggtgacagcatgctggcagccctcgcagccctcgctggctctcggagcctcctcagccttggcgcccactctagtggcacttgaggagcccttcagcccgccgctgcactgtgggagcccctttctgggctggccaaggccggagctggctccctcagcttgtggggaggtgtggagggagaggcacgggcagcaactggggctgcgggcgtcgcttgcgggccagcacgagttccgggtgggcgtgggctcagcgggcccgcgctcagagcagccatccggccccgatggcccctggcagtgaggggcttagcacctgggccagcagctgctgtgctggatttctccccggccttagctgcctccccgcagggcagggcttgggacctgcagcccgccatgcctgagcctctctcccctgccccactccgtgggctcctgcacagcccgagcctcccctatgagcgccgctccctgctccacggcgcccagtcccatccactgcccaagggctgaagagtgcaggcgcatggccggggactgccaggcagcttcacctgcggcctggtgcaggatccactgggtgaagccagctgggctcctgagtctggtggggacttggacaacatttatgtctagctaagggattgtaaatacaccaatcagcactctgtatctagctcaaggtttgtaaacacaccaatcagcaccctgtgtctagctcagggtttgcgaacacaccaatcgaccctctgtatctagctaatctagtggggacatggagaacttttgtgtctagctcaggaattgtaaatgcaccaatcagcaccctgtgtctagctcagggtttgtggatgcaccaatcagcactctgagcctagctaatctggtggggacttggagaatctttatgtctagctaagggattgtgaatgcaccaattggcactctatatctagctcaaggtttgtaaacacaccaatcagcaccctgtgtctagctcaaggtttgcaaatgcaccaatctatactctgtatctagctaatctagtggggaggtggagaacttttgtgtctagctcagggattgtaaacacaccaatcagcaccctgtcaaaatggaccaatcagctctctgtaaaacagaccaatcggctctctgtaaaatggaccaatcagcaggatgtgggtgggccagataagagaataaaagcaggctgcccgaaccagcagtggtaacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctcc

SEQ ID NO: 696 - DNA, 22118 bp, Homo sapiens
acttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctctttgcagactaactaaaagccaccatatctaagtagcatttgatgagaagaaactagttatttatgtaaaccaaaataattaatgttacaacggagaaactttatatagcagccacagatgaagcctggcatgaggaagtcaatgatcagttgctgctctcgccatatggtgggttataaaatcttcccaagacaagtgaggcaccgagaaattgaagactcatatacattccagagaacagggcctctctcatccatctcctccattagggcctttcttcatatttcatagatagacagctggagccagttctctgcttcctgggccctctaaaagggccaaagacttggacaaatccattgtcctgggcactcaggaggcaagattctgtgtgtgcatgagtgtacgaacatgtgtcatgtgagagagtgtgtgggcactgggcacacgaagcatgagggtaggtgagtgaacatgtgtcagcctacatgagtgtatatatatgtgcacagagtgtgtgagcatgtgtgcatcaaacataagtttgtgtgaacgtggcaccacgagtgaatttgtgtgtttgtgtgtggggtaagtgaacatgttgcagcctgagtgagcaagtgtagtgtgtgcaacagggatgtatgtattcatgtttacacatgtcagcttaagtatgttagggtgtgtgaacgtgtgtcagtgtgagtatgtgtgggcctgtgcacagaatgcaagtaagtgtatgtgtgcatgccgagggtgagtgagagtgtgtgtgtgggggggtaagtaaacatggctgggcatgggtgagtgtgcacaccaggtatgagtggctgtgtgcagtgttgtgtgtgttcacaatgagtgtgtgaaacagacctgccaggccatgctagtgagaggtgacagcatgctggcagccctcgcagccctcgctggctctcggagcctcctcagccttggcgcccactctagtggcacttgaggagcccttcagcccgccgctgcactgtgggagcccctttctgggctggccaaggccggagctggctccctcagcttgtggggaggtgtggagggagaggcacgggcagcaactggggctgcgggcgtcgcttgcgggccagcacgagttccgggtgggcgtgggctcagcgggcccgcgctcagagcagccatccggccccgatggcccctggcagtgaggggcttagcacctgggccagcagctgctgtgctggatttctccccggccttagctgcctccccgcagggcagggcttgggacctgcagcccgccatgcctgagcctctctcccctgccccactccgtgggctcctgcacagcccgagcctcccctatgagcgccgctccctgctccacggcgcccagtcccatccactgcccaagggctgaagagtgcaggcgcatggccggggactgccaggcagcttcacctgcggcctggtgcaggatccactgggtgaagccagctgggctcctgagtctggtggggacttggacaacatttatgtctagctaagggattgtaaatacaccaatcagcactctgtatctagctcaaggtttgtaaacacaccaatcagcaccctgtgtctagctcagggtttgcgaacacaccaatcgaccctctgtatctagctaatctagtggggacatggagaacttttgtgtctagctcaggaattgtaaatgcaccaatcagcaccctgtgtctagctcagggtttgtggatgcaccaatcagcactctgagcctagctaatctggtggggacttggagaatctttatgtctagctaagggattgtgaatgcaccaattggcactctatatctagctcaaggtttgtaaacacaccaatcagcaccctgtgtctagctcaaggtttgcaaatgcaccaatctatactctgtatctagctaatctagtggggaggtggagaacttttgtgtctagctcagggattgtaaacacaccaatcagcaccctgtcaaaatggaccaatcagctctctgtaaaacagaccaatcggctctctgtaaaatggaccaatcagcaggatgtgggtgggccagataagagaataaaagcaggctgcccgaaccagcagtggtaacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctcc

SEQ ID NO: 697 - DNA, 26883 bp, Homo sapiens
caacatggattacagtatctcttccctaaataccagaaccatatcaactttaaatctgcctaatggcatcctaagaactgatgaagaaaaatcgtcttgtttcacgttcagacaggttagaagaatccatgggcttcttgctccacattgttcaatgctttccaactcccctcaagacatgattcatgctccaatattccctattctatataattgccaaattaaagctctgtttcctaagtcagacattctaaaccaatgtgtgaaaaaacagctttgggagggttgagttattttcctcagtccttagagtggctacatagggcctgaggccagtggtttccagccatatgcagctttggcagtttactctcgtgtaatatggaaataatatattctatgcatgctgtgactttgctttttttttttttttaagttagggaagaactttaaacttggaagacctgtcccgagtatagcaggtagacactttgattaatattacaagattagctcatactaatttaggaagcatttggaacagtgtccagcacatggtgagtgaagttaaagtgcttatcaaaaaacacatataattgaagctattatttaaaagaatttacactaaagtataaatgactaatatgttcaatgtaccatgagggtgttagctgactaataaaggatcttgttaatctgaatgaatttctaattggataaatcacaacttgtgtgatgaacccttgcaatctgtgcattttatgccttgcaaactagtcctataaggcagaaaatgcacagatcgatgttgttttatagtagaaagcatcctgtcacctacactttctatcctaacacccttacaagtgatttcatatcccataggatttggtaaaaataatcatcattggagcaagaagtgaaagttggcaagaaccatagtggatatttaaaatcaaggaattatacgtataaatcaataaataaattctggtcgattaatgccaaatatcatcaaagaatagagtaaagcaatctggtctttgcacagtgctttagcctgtcaaagacaatgtagcaataagcaattttaccaaaatatcataacacaatatctgacagttgagaattattgtataatcctgttaacttgattagtcaaatatacaagttagatttttcaatctatgttgcactgattcccaaaattagatctcaaatcaggactgaaatagacctatcagtaacatggagaaatttcaagtatatttctaaatccactaggaatcaactattgtttttttttttttaactttcagtgcctttaattctttgcatatatgtaacctttgggaaaaaatatacattgcagggtttgacattatgtatgaattctatgcacatagattgactgctactgagtctccaggaggctttggagagagcaaagtggcactgaatttgatcatagaagacagaatcatatttttaaaagaattctcccagcaattcagctacatagcaaaggtttgtcacttttcctctcaaacccttctggctgtcagtgctcttggaggaaggtaaggaggaatgcaaacaaactactggggtgaaatccaataatagagttgggccctactgggggctcctgggaagaaacagcccatctaacgttacttccactgctatctcattgtccaaatcctgcaattaaaacctttcattaggccaggcgtggtggctcacgcctgtaatctcagcactttgggaggccgaggtgggtggatcaccaggtcaggagttcaagaccagcctgaccaacatggtgaaaccctgtctctactaaaaacataaaaattagctgagtgtggtggcacacgcctgtaatcccagccactcagaggctgaggcaggagaatcgcttgaacttgggaggcggaggttgcagtgagccgagatcgtgccactgcactccagcctgggtgacagagcaagattccatctcaaaacaaactttcattaataccgtaccttacagacttaaggtgtggccaaagaagtgatcctgtctgctcacaatgccagccattttccctttgaagcaaccaggagaaagatttaatggggcctcataaatgggtaagggaagaagtacagccaacatcaaactgagctactaagtcaggctttcaactcaggcttagcatcctttctgcttcagcacagtagcttcactgagtctctgcagctttagggagccattgcctgaggaagtagctggtgatgatggccattttggagagccttgggagaggatgcaacacactataggaggctgaggtgcttagtcttctgggcatgcaacagacatggacaaaacactgctgaatggcagtaaaatctgctcagcgttctttgccttgtttatgatcttcttgttatttaggaactaattacacagtctgcagagtgtctctgttcccaggccttgtgctgctctctgaccacttgcctgcctgttatttctgtctgtagacagaggtcagcaagagaagccatcagagtttaatcaaacttctcccccacttgttaacatcagtgacaaaatctttgatgagaacagaatgtttcatacttggctatcaaggattcggggatctagggattatttatggatttcgttaagcacttaattcccatccactgctattgtgaatagctgaggttttgcctatatccctaacacaatttcaaatctgcagaggggctcctatgccctgaagtgctgagcatgttcaggttgtcatgcctatccaagaattctgggttgcacaatacaaaaatatgcaagaagcacttgtgtaggattacagggcaagacaggtgaaaatgttttaaagtgtaggaacatctcactttgaacaatagagctgtttcagaaaaagttcttgtaaaatggatttatgaacatttagttacattttaatcgaccagaggagttgataactcaaggctcactgtgcaatgagctcttttgcaggtgcaaagtatttatgtgaagaaataattccctccccatttagctttttatgaatttgaattttaatatatcaagttgtcttaaaacacctgtatagctaaatctgccaagatgcttttcactgaatatctggtagatgaaggaactcattctcccagggaaatattataaacactttcaaagctgagaaatgcttattgtaaattgaacataaagttttcaatgggccacacctaattaggtttctacgcctcttgaacactcactctccgcatatgggagaaaagcaaggagagcagttcatatagtcaggtttagaagtttttgctttgtttaatgttaaatctatttgttattgtatttatgtatatttgtttctaaatatttatgtatattaagtttctaaatcttgtatctttgcaaatactttaatcacttgcctacagaattttcatttagatccaaagaatcagaataagctcattttcatttataaatttcatctttttctgctgtttatgcctcatcttttctcttctactcctaaacaaaagcttgtgtttttagctcccattttccagatgattgctctgtctttgctgtcatttgtgcagacggcttcagagttcctgcacaagcatatagtgccataaaaataagccagatttttttaaaaaaatgtttaaaacatagtaaatctgcttttgcctactgtttgactttctcttggctcactgcctgagatccattaggtacacttggaatattctagccctggacacgaaggaaagaatttgcttttaagattgctttgtactatttaaagtcagagatgatagtaaccagaacaatggaattgagccttgttgccaagtcttttggtttatggctcttccttggctttggtattcattctcatctttgcatctgagatgagaagtcctattttggttaatgacaacttccctcacacatgcctaatcatccttagaggcagacctggaggctcttttggttgtttaggcatatgttcatttataaacaaaaatgagtgtattctgattcttctggtctaaatgaaaattctataggcaagtgatcagttagtaacctatcccacaagacagggcaggaaaaattagaaatggagagtcatggaagctgactgtattggtggacaccacgttttaaccatagtattgtttgtttctggttcctaagcaccaagggaagtctactagcatgcacacaaagcctcaagaagcttctttacttcaggcatctccttaggccaccttgttaaagaatttactttcataatcagtttctaagaatcagtatttcttttcctattttcctccacttggacataacatgattagaacaaagagttctcatgctttgggactgatcagaatcatcactaaagaaaagactaccaacagtcctaccttcatgtaggaactctgttgttttccctccacttgcacatcataatggctgtgagaaatgaggctctggaggaaatcaattcacatggagccccatcttcttggagggctctctgggaggggcaactgcaccaagatttttgttgaaccatatttgctgcaacgatgacgtgtccatcacactcatatctctcgagaggccccctgggagatagtggcattttgcagtgagtgtggcctattctgggtcataccaaggactatttggatctatctaatttaggtaaataatgatgaaatacataggggttttccctgtcttaagaactggaggatgttttcgaaggctttcttcaatcagtgggagggtacaaacacttgaaagtattcacactggattactgggtaagacaaattgctcatagccacccaggttagaaagattgggatttaacatgacaagcaatcagaggctgaatcgaatggttaaagggtctgtgtccctttgtagaataatcagagattgttaatgaagcacaaaccagaaaaattgttattaggcttgtaagtgctggtaatataatgtgtccaaaaatacatggcaaagcttactctcccttaaaaagacacaaaatttacacaaaaaaattttgtgaaatgtgtatggtaaaatctttataaaagctgtgaaatgtgcaattgatttggaaaagggttaatgccagaatattttaaagctttactcccctccttgcagtgtaatccaaagatgtcttctgttttttccttcctttataaactcaaactcttaattgaaaagcagtctgtgttactcaatatgaatgaaataagtacacttgggtcaggtgtagggttgggttgctttggacagtttaaaaagattctcctcttagcccttatctgtttgttccctgaaggatttctgtatcccttcaggcaaaccaagcagtagcagcagcaataatcttatttacaaagggggcaggagggcagagggctggaaatcccaagggctagtgctcaatatggtccctgtcatcttgagatcagagggtttgccccagcccaggtgaataatgaccaagaacactttgtgactgatgactctgctatgtatggggagttaattgatgtccctctgttccaagtgaataatccactttctagcaatgatggtaatgtcatcaagtgggaaaatacacagccagctaatgtagaaacaagatatagagtccccacccccaccccggactctcttctgggcaagcaggaagtgatacttttacagatacatgcaatgcttttaaaaaatctccgaactagcagaactaggaaaaaagctatctaaactttgacctttttgactaatattatgaatcttctcagacctctgtaaaccacaacgcaggtgcatcaagaacaattaatcaccttagcatctatgacccttggttatctggccctccgccctcatcctcattactctccttcacgtaccatgtcccatacacatgagactatgtgtcattcactggacatatcacactgtcttacatctctcccctcttacccccaactcaccataatttatctccttggagcttcctttatccccatttttccctttattcttttcatagctagctcttactttgtctttagtgctctattcaagcatcacctcttcttcctaaatcaggtatttgtgccctttctagtttcccatagcctcctccattttagcattgattgcactgtgttgcaattatctttttaagtgctcacctactttcattagatcttcagtaatttgatggttcaccatggtggatatatgcacagcacagttcacttatatagaaattggcttatgggtctcaactcagtaacctaatagttaagagtgaatctgagctataccacttactagttgtgtgatcttcagcaggctaccgtctgtcaaactggaacattaatacctcacagagtggctgagaagattaaatgagatgattcatctcatactaaatgagataattcatctcatactaaatgagataaataccaatcattgttatcaatgccaagtacgaggtaggttctcagtaaatacttgctaaattgtattttacagttttcacaatttacacttcactggctatcagagtattatttcctcaatgatgtattctacgtacaagttaaaaataaaagagaagttttgtttttttttttaaataagtgagttaaaatcaaaacaagaaagtggccaaagggctggaaaacttgctactgtaggtgggactaggaattattttagtgcctggctctggagatgaaataaatctaacttcccctcagccactctttcagctatccaaggtgtgtgatgattcatatgaggccaagtaacaaagaacacaaatttaatttattttgacatccagaataaatttgacaaagtttttgaattgctgctgtctggaaagggaaggaaaggaaatagaaacatgtacctcatcatacccatgctcccttgcaatgtggtgtgatggaaagatccagagtttagagacaaaagacctgggtttgcattcaagagcaacttactaactacccatgtgaacttgggcaagatacttggcctctttgagcctacatatgtagaattagacatttttacattatttttactaggcattctggtaggtagaggtggtggttttcatctttaaacttgttagcacatgggaaattttcaataaatacttgtggaatatatggctttaactgaaagaaaagtgaataaaaggaggcactgcttaataaaaataatttgggctttggaatcaggaagtcctgggttctaaccatagttaccttgtctttacctcacagagttttcctttcgcttataacatgaagttaataagagagacatcacaaggatgctgtgagggttaaataatatatataaagtgctggcacaatgcctgacactcagtaggcacaataaaatatagtgtctttgtcctgatcactagctaaagaactggtatagacattattaactgaataagccaaaatgaaatattccaacacagattaattctaatactttacattgttgtagccttttgcaggtttcaaagctcttcaaaacactttataccatctgatgttactgctattttcagagctggcatttttacagatgagaaaatcgaatcaggggttgtggcttgtttgagtctaaacagctagaaagtgagcacacacttctacatttccgctacaagcgggtctgcatctacacagcggtaattcctcctccagtgttctttccaacacagtggctgtctgggtcaaaactgggtatctttgacatttgtcatgattctgatattagccaaaaagattgtgtactcagtaaggaacatatgaacattttcaaatagatcaggcttacccaaagttgtattctattattattaaaataaacacgtgaagtgctgcattagtcatctatttcttagtgttaagagaacaattatttgtttgctctacaaatatttgagcatgttcaatgtaatgaaggaggtgctgcagttaatacttgggagtcccagtgtctgatttttctcttaagctaagattgcaactgtaatattttaatcactcttcccatttgtcaatttcttttgttcatttcccctttttttggatgtgtcacagggaactatgtagtctataagcccaggtatttgttatttaatattacccagaaacttttgaagtggttaagacagtacttaatgaccagcatttctgaggtgttcggagaccaacccattacatatttcacctcctaagctaactagatatataccctccaaatttctcctatcagcattccaggggtagggagtaaaggaacaatgatgatgtgtactgttcattttctaaaatccagtatggagccaagaactttacatgtatcaccttcaatccaggaaaaacttacagaatattctagagatgagtatagaaattttccagttggaaccatccttgaggcaaactggagtttctgcatgtcttaattgattttgtttctacattatcctaaatgtatattccaatatagatagtaacatatattgattgtggattagtttttgagtcttaagatactctatgaagatactaaataagtatctttctctcatcaagtctcagtatgaaatttaagagctggccgggcgcggtggctcacgcctgtaatcccagcactttgggaggccgaggcgggtggatcatgaggtcaggagatcgaggccaacctggctaacaaggtgaaaccccgtctctactaaaaatacaaaaaattagccgggcgcggaggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaaaaaaaaaaagaaatttaagagctaagaatatctatcatttgctttttgttaagaagcattcagcttatgcacccagccagagtttactaaaagaggcagaatgatcgatttttgactatagtcattaaaaagcaaagataatctactctcaatatttcaacataatctattttcaaatagttaattacttgaaaaattaaaatctttcaaaattgactgcaaacacacattatttcagacagtaatatttaaacttcattgtaatgctttcttcattataaaatttaaaggtattttctcttattgttcaaattgaaattatgagtttttacaaactgtgttgaaaagtacttatctcttttctgtggttcaaaatatacagtgctcataaattctttcaatttatattgtactatgtctgttaagtctcaatttacacattatgaatggtatgtttgttttaatttactgcaaaatcagttaaaatctttaatgaaataatgctttttaaaggtgtggtggccttttctgctttattgtgtaaaaaatagctttttgtgtgtttttcctatggtaaaaataaatagattaatccaatatgtccccacttttcaagtagtcattagtgctttttgaggaataaattagttcagcaatcttttagaaattaaatccttagtattttgccatcagactgtgaaataaggcagagttcaaaggcattttatgttcttcatggtaatctagaatttttatttgattccaggtaactttggacaatagacatgatgagatgttttctctttgaataagttaacagtttaattacattgaaataaaatatactgtgggcttaatacattgtaaatattacagaagaagtactactttgctatagtaatttaatgactgaagctacatttaataacaatcttaccagtacttgtatacaaagtattatacagattactaacgaagatattgcagtggttgcaacgatgttaccagctcaacaaacatctaacaatacaatattcttctaagaggaaaagtaataatgttagatttacagacaataaagagtcatgtttcccgcttgaaacattggaaataaatttgaatccagatacaagaaaaggtttcctttcttgggaactctgatccccagtaggcctagtacagtcaatttacatgaagatagcttttaagatgccacggcaatgtaaagaaactctcccatccgaaaattactgatttgtaggccactgctcaaacatctgactttttagaaacctatttacatacattcagcccaaatcagtagatagaatgtttttttctatattacaataggcattgttaacatttcatcagaaggccagtgcaagacaattaattgttaatagccattgcccagcatttaggagattttaaaatatcatacaaatatacagttagagtgtgagaaatctaattgtgtgcatgatatgggtggtctcttttatggacatgaaatggcagaaattaatcaacaggacagtaactatagcgctactcatccagggcctaattctcatctggtggttgggcctatttcctgcagagtggatttaggcagcaaaaggtccttggcatttaataccagatagacttaactcaaagtgccagagaggcttggaaatcatctcaagtgtaggacagatgtctacagcatctctcagattcatatcctttcacatatatttcatacaaaataaatcagaggttcctcttggaggcagccctacttgtgcaaatgaaacattctaggactgattcatcatgactctgataaaaaaaaaatgagcaggttgggaatttggccctttctgaacatgtgtgatggtaaaatgcatggtcagggcaagtacatcatcctcagaggaaagtaagatacctctgatgtcagaccttataaaacttacttaaatttaaatcatttaaattaatggatctaattatggggttaattaatgagtgatattaacaaatggtaattctaatgagtatattcattggggacaatgttttcgtcacttgggttaagaaatgatatgaaaagtgtcaaagtgaatctaactagttttaaacctttttaaatgaaggttgtataacatacgtgatgatatttcacagatatttcttagaatatcaataagcaccaagtttagtgctgtcagccccattgtcccttaatttattatatatgatttagatcttgaaagcacaacacactataaaatctacactgcatacgcacaaatgcagtttcaaaaatgaatcgtgaaatttttctaccataacaagaatttctctagctcttcatagctgtgaaaagagcattggtactgcctggtgagctctgaaacatgtggattaatgttcaagatgatgcaggacaaaagactggcaattcttaaatgcaaactaaaccctggtgagttcttcttgtaaataatctctcctgtctttagaaagagatcttactaatcctctagcaccctgagccttcatctgcacatgacagagaggtaaagtaagggagccagcaggcagattcaaggtgtgcagacagacaatgcaaagtatctcataagccacatcctgccttagagcgtgaaccgtaagaaggggaactgccccatcaggctgcttgggtatctcgagagctagaaatcaccagatagatgccagctctgtacttcacttcagactatgtaaaccttggggccttgtaggagtcatgttttatctgtataagaagagattataattaaaatttgtcagggttaagtagattcttcagcaatatcattccttactggaaaaaggcccaacaagcacccatggcgccattaaggagcatgagaccggggtgtaagaagaaagcagctgtgtttatcttcatgcttgagtgtatcttgctaaccacgagcaaaggagagatttgttccttagcccaaacctaccaagacagagctgggtgctcagctgtcaccaagggcatgtgggcaaagcacagatacagcatagctagacgtcaatgccaagtgtatcggttcttcactgccgttgtgtgtctcatccactgtctgattcagcttttttagccacatgggctgggtgtgatagtcctactttaacgtgatgtatatagtgcatactatctacacacgctattgaaaaatgttaccattgtttttctgtagaactgtcttccttttagtgactgacatattgctcaatattcggtgctcagaaaccaaagtactctcctttcctggcaataacactacaaatacatcccttccttggatgcctgtcattattttttgctaagcactggtcttgtgtaatacctaaaggtcaatttagtaatacttgatccaatctcttaaggagggatggggtgaaatttttgaatggttggagtcagtatttttatcaacaagattacaggaagaactcaattttagaaactgaatccatgtgcaagagtgcagcaagtggtaaaagtttatacttggtcacagttttctcactttatgacattactgtaacagttacaggacagaaacacacatacacacatttatattcacactcacacacagtataattttactgatccagacactacttcttttcaattaaaaaaaatgaagactgttgtttggccacccaggcatgaaatctacttaaacctggaatataggaacacaatactattcaagtaaacagcaactgcacagtgataacgatatacattaagattaacacatgctgtcttaagagatccagtaatagctaaagactaaagaaagtcagagatgtcgctcaaaaaaagtcaatatgctttctctcttccattctgattataatccattagaacagctatagtccagaagataatgtgtcttcctatgaaaatgcagggctaataaatttttaagtatgaatgaattctgctcaatattttgaagtcttcaaattcttcttgttgaggtaacagaaaaataaacctttacggttatttcagtgtcaaaattaaatagagatatttgaagaaatattaaggtttatttctaaagttatatcatgggcaataatatagaaaaaaagtgcacacattgacacgtatccactgcttgtccattgttctcataaaagtctacctttcagttttgctgaactaaacaaatattaatagcacataaacactgatacacatctcacaggacataatacattttacaaaatatctctagtactataacttgtaaaaatggacatctctgatactacggacagttacatttcacattatagtgaaagttgtggttacaaaggcattattcatttgatggcatttttccatgggttcttagacttccaattgtgtagccaaaggtttccctcctatttcattgagactttgaaggatcgttcagtcacttaaacaacaggctttcttcactgtaaacccctggagaatggagtttgagtacctaaactatggaaacattagcaaactgataagtgatcatggtgacaatcaccttttcattgagcatggtaaagttaaaaaaatataaccaaggagacaatagactcttctagattttgagcttaaaaaaaaaaattcttttcctgtgctgccagggaggcatcaggctcacagagcctcggcagacgtgtctgtggacacagacatggttaccttggcaatcttgaccgtgctcttgatgcagctttctgcggccctgtgaacactggctgcattgtttgcgtgtttgtgcaggcagtccgagtcccccatgctgttatccagaggctgcgcagtgccttcacaagagggaaacatgctccggaaagcgtgtcgcaggtccttactcctcagagcatagatgatggggttcacggtggagttcagcaggcagagcatactgcagaatgcaaacaccgtcttaatgagcttgttcatcttcccaaagacatcatacaccatgattgcaagcagagggccccagcagatgatcaacaccaccaggatcaggaccagggtcttggctaacctaatgtccatgcgggcttggtctggccgggtcacctgtaccttcccatcctcagacgtgtggatgatgatgctcttctgggtgccacgctgaatcatgcggacggcgtggctgtgagccttccagagaatatacatgtacgcatacacgatgaacagaagcagtacgctggtgaccccgatccagaacatcaggtaggtttcatcaatgtgtgggaaaatgtctgagcaaacagattgcagtttctcgcagttccagcccaggagaggcagcacggcgatcacaatggctatggtccacatcaggcaaaacgccaccacggccttgggcctggtgacaatcctcttataggccaggggcctgtgaatggatatgtacctgtcgatggctgtgaggaacaggctgcccacggaggcagtgaaggaggccgtgaccccacccagtttgaacagaaacacgttgcggctatctttgcggtggaacacgtggaagtcaatgaagctgtagacaaaaatgacactccccaggaggtctgccaccgccaggctgccgatgaagtggtaggaaggcctgcagcggaggctgcgggagtggaggatgacgcacagcaccaggaggttctccaggaccgtgaaggtgcccagcgtgagggacaggactgcaatggccagctgctggctggggttcaggaccatgaaacactctatgtccatgaagttctccccacactggatgttctcctcattctccttgaaggacgagagagacttgttgtaaaattctgtaatgttcacctggtctgctgggactagctgggggttgtctcccgcagtcatcttctcttggaagggacttcccctaaaggaagttaaagggaatttctgtgggaagtaccctaatttggatgccatgtcacctttgatgtcttcgtactgaatgtcatttgagcccacgtacaggaggtcagtggtgatggtgcggaaggtggtatctgcaaggccatctaggatcgacttcataacctcagtctttgattaggctgagctcaaaatgactgagaaagtgacccacagggggcaatcctaagaggagggaaaacaaataagccgaatggtgagaaacaggaagaataaaaacaaagagacactgtaaatgtggcaaatgtactgtcatggcaactcattcctgtctctgaacagtaggaggtcaagttctcatcagattcagtcaacaaaatgagtaagtcactcagagaaaagctccccaaagttcagggatggcgtggcacatgccagaaatgtatcaccttttcattatttaaaccctctgtattgaagtcagtgtgtgaatccaggaaggacctccagggccaagaagactgaactaaatgaaatgtttcttggggacaatgtccatttcatagtcacgttaggaagtgtttagcacctggcttctcctgtcacacacacatggtatcccagtgctggttggggccggcgagagcactgatgtgtcacatgacccctactcttggagacttcaccttgtcagacaaatgagactaaatgtaaaagacaaccaaagaataagacagtgtagaatcaagtgatgagttgtgtggtctgtatgttacttgtagcgggggaggagggagctagtgagaactgaggaagcttgaggccatgtggggagagatgctcctcaagacaagtttcttcacccagagaaggggaggtctggacggagccatggctgacatgacttctaggatgtccacatcaaccaagaaaaatgtcacaaagaccaaacttgcaatgaggcgtataggaagacagagttttttttttctttctttctttctttctttttgatacagagtcttgctctgccaccaggctggagtgcagtggcacgatctgggctcactgcagcctccacctccccagttcaagtgattctcctgcctcagcctcttgagtagctgggactacaggtgcgcaccaccatgcccggctaatttttgtatttttagtagagacagggtttcaccatattggtcgggctggtctcaaactcttgacctcaggtgatccacctgcctcggcctcccaaagtgctgggattacaggtgtgagccactgtgcccggccaagactgagctttttcacagcagggatatggaggaggcctcctgatagtccccttcatgagcaggttggtgacacaagtgtgcctggtgacaggagacaggctggagagtgtccaaggatttccatgtgaacagctaagaggaaaggcccaaactttaaggttcttcgattctaagctaagcaatttggttttgtttcaaaataaacagccagagaactgatcttactatttataaatttttgtttaaaatgtgggctattcatttctttagtttatttttaaaaattagaagtatagagtgatatctataacaattaaaataagaattaaaacaatatattacttgttaattggcatttgttgttcctgaaacatatcacactgtatggggttgggggagagacaatcactatttcagaacaaattttaaaaatgttgaactaacaataaatgagttattaattcagagaccctaatatctgaattaataattcatttattcatgtattaacaaattatggagcatccactatgcacttgtattatgtctagctacggtactagacactagtgttgacagcatcaagaaagagtccctgcccttggccgggcacagtagttcatgcctgtaatcccagcactttgggaggctgaggtgggcatatcacgaagtcaagagactgagaccatcctggccaacatggtgaaaccccgtctctactaaaaataaaaagaaatttaaaaaaattttaaaaaaattagctgggcatggtggcacgcctgtaatccctgctactcaggaggctgaggcaggagaatcgcttgaacccgggaggcggaggttgcagtgaggcgagattatgccactgcactccagtctggcaacagagcaacattctgtgaaaaaaagagtccttgcccgcatgaaggatatgatctagcagaggaggcagacagctgactcagaaattaaaagaaagcatggggagagctacaattggggacgtacaggatgctctggggacacccagtctagagggctgaaggaggtttccccaaggaaaagatatttatgctaagaataggtagcatcactgtaggtggggacaggacacagagtcaatgaaaataattttatttaataccctagtgtcatgattcttaagaaaagtaatttggaacaggcataaagtgttaaatgtggcccaccttcccacattctgccacctccacttccaggatctcatcactgctcaccagggttagggcgcctgctttctgaccagttttcctgctcttctctggtcctgttcctttttgatcacttgccacacagctgtgggggtaatcttcataaacgtatgctgattatgtgactcccctctttcaatctctttgccctaaaaaccaaatataaactttcacgcagtttccttttcaggcccaggccctccagacatgtatgcaactctcgtctgccttctatgtttccatccagctgagctcctttccaattctgaccctcaggctcttgtccttaatactctccacaacctgtctccctaaacaggatggctttctatctcccacctgcaggatgaagtccagtaaaaagtttcctgtgatctagctcccgcccacctctccaatcttcttcttgccagccctggccttgccacttgggctacaccagatgaattttagttccataaacacagcaaattgactgctcctcacctcagtgctgttgctcccattgccccttacactcccgcctggtcaactcctccccatcactttgatgtcacttcttgccatagctccctgcttcccatggcgatgaacaccctttctgggctcccagaatacccaaacagagttctatcatggtactgaccagattttctaatacttctttgtgtttgcatctgttccactacttcctcccacccactagacagtaagttcactgaagatcttactggggactttatcttagtatctactcagcatttagtagaatgcctaacacacagaagaaggctccaaataagctggttgattggatatacgtatttcaaaatagaacaaaaacaagaagctcttttctacccaaagaaggggaaggattctcccaatgctgattaaaaaaaaaaaatgatcatgtaacttgaatcaagggatctagcctggagagctgcccaatccaattgtgctagaaatatgctctatttaggtaaggttattagcattttaaatgaagctgcctatataattatctagtctaaactctcatggaatgagctatatgcaataagcaactttggctacagagaggcaaacaagaatattggcaatgccataccaaatggtgaacagagaaagagccctcagcactaatgtgacaggtaagccagaaggctcccttagctcctccatggttgtgtaacccttttacaagatcactgtagcctgtgatggcagtaggaggcactgccaaactgagggccccgaatctcccatgggtaacttctatcatcactaagaaaattgagggttttttttagtctgggcttctgaaccagttctgcacacctttcctgcaactgtcatagaataaagcagatgggagccatcacctactggaccagaggcaggagctctaaggtacaagccacacagaggcacccagtgtgctggtacagtctgctaacgccaatcaagtcaaggcagtgtctcaggggcaaaggctagtggctatagaaataaaggatgcagaaataaaagaccaaagaccaacagccaagccagttgcccagtgcttctgggctcctttatctaaaatatctcctgagttcctaccctcagcctggctccaatgttaactctcgagtatccttagtatccttaggttccctgttcatctgtctgtctgtcatatcttttctcatatcctcacctcttctagaacatgctctatatgtcccacattcggctatttctcaggagtcaactcttgctccttgcaaacttatgtttgcttaacaactccatttacatatggaaagttttcatccataatcaaagggacacagaagacagccacaatgtgtgagagctgttccttacatggtccttgcacatccacaaacctaacttttgcctttcgactcccactcatacttaaacaccaggcttactggccctgagtgacttgctgctctttgaatacaccgtcatacctgcacaccttcctccttcaccttgtcccttcttttatctggatagaagctctctgcctactaaacttatctttccaggtctgtgccaatgctacttccatgtctgagaccttcctgaccagcccctcccactaggtataactagttccccagcacatccctctattacaggcctcatcacgtcgtataatcaggagttcacatatttatttccataactagaatgagatctccaaacacagaggcatctttttttcttaagtggtttaccagcctgatagcatgatagcaggagagcagacagctgagttcccacagaaatgttcacctgaacctaataaaatggcagttgaatttttattaggtggtaccttaaaacagtgatttgcatttgcctttttcttaaaattagaggacagaaaaaataatttatgcaatagacatttagcctgaaaaccagagtttgagcctccatctccaagtagctcctgtgagccattccagtcatcttcccattccttatgccatcttccctcaattaactaactccccctttacactttccaactggaaactagtttatcagaaattttgattatctttatgtattagattcacaagatttaagattcaaaaggtacagaaagacatacagagaaaagtcaatctctctcatccctatatcccagccacctagttttttttctcaaaggcaaggagtaagtttcttgttaccccttccagagatactccatgcatattcaaacaaatatatgtatttaccccctctttgttttctttttagcaaacagtaattaacattattatacatacctttcttttcttcttagaagtacacattgtgaacagttccatattcgtatataaaacctctctcttcattcagctgccttaaggatctgttagatgaatgtgaccagcctcctactgatggaggtttaggttatcatcttttgctattagaaatgatgctgcaataaattgaatccaaccacaggtcactcagcaagtcactcaggaccagtaagcctggtgtttaagtatgggtgggagttgaaaggcaaaagctaggtttgtggatgtgccaggaccatgtaaggaacagctctctcatatattgtgactgtcttctgtgtccctttgattatggatgaaaactttcatatgtaaatggagttgtttagcaaacataagtttgcaaggagcaagagttgactcctgagaactttttcacatttcttatggcattgtgagtagtctttctagtcacctaagttcctaacttggacttactatgacacctcctctttcttgacctctacaatcaggtagaccactaagtcttgctgattttcctcttttaagcatatagagagagcttcttatggactggtgacactgagcctattacatatatatcaattcctttatttcacaatggccctatgaagtaggtgctattatccccattttcagaagaaaggcacagagggtaagtaagttgctataggcaaagctagtaagtagtagagcaagcactgcacccagatgagagccacatttcaagtccttaatagctccatgtggttagtagctactatactggacagtgcaggtctagggcccttacttgtagctttttttgatacaccatctctctaagctaagacagggatattaccatcttccttgttttcttcactgattccaaccagtcaaagcacctagtcaatggaattaggagttagcagaccaagattggtgttagatggtacttgggcaatcagtctttctaagcctcagtatttcatctgtaaaatggggatgaggatgatgacaataatgcctaaatcgcagaactgatctgaaattagatgaaattaaatgcatgtaaaacatagtgcctgacacaaaagtaagtcttcaatgggtattattattatcattacttagtattatggctctttgctatatactatatactaattatattgtaagaatatattataataatataatacatactaattatatctcaagaatgctcattgccttaattattcaatcttatttttgcctcagcacttaaaacatgaagcaaatagtagatatatatagacatgggtaagggatggggaacctttattgaatgtctgttatatccagccatttgagaaactttacatatattctatcattaaattgtcaaggcaaccctatcaggtgcttatttataatccccatttcacagatgaggaaatggaggccatcagatgttaagtaaattgcctagaatatgatggatttgcagatgaatcgaagtttctcagactccacagtctgttttgagattttatgtgacgatttcagaattaacagtaactaggttaaagccattttgcatcttatatttaagtcttctggattcttagaaatgtgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaatgtaaattaaggcattttgccaatagtaattaagactacctgctactaaatccctatttcctatcaaagctcatctaggtaagtctacctacttgcatggacctaaagattaaaatttagtcactacttggaagagctataaagcttcttcagtgaagacaaaggatcacatatcttattccagtaatgcaaaaaacatgtttctgtgacttactttagattaagatcaccgcaagtgtgatcacaacttcccattttaatgcaaccaagcactttcattaaaacaaactagcttgttaaaatctaagctagggcatgggtgtggttatatgataacagagtaatttctgtccaatataagccaattgaattaaagaatacagttaataatatatggattttatgtagttcaaagatctcagtaatgtcgaaatactactgtgcacaggctattttaacagttaatgggatcatggcaggaaaactgctctctgcattttgataattctttcctttatttctacatttggattattacagtaatttccaccttattattttttgcatcaacaacttcctttgagagttcattactaatacggcttaggctttgggggatgtagctgccattaattttgtttttgtttgctactaggaaaatcataattggaaatttctagcaagatgtatagatgcacctattaaagaagcagttggtttttattacagttatagtaaaagaatgattgaatgacatataagggaattttcctagaattctgctttaaaaaatatagccaacatattctaacagtgtaagctatataaatcatgacttcatagtaaagataaaaatatcttaatgtattaaatccattatttttaaaaaatcactccaatttttagactatcatctattctttttgtctatttctctgtatgcaaacctgcctctccactacctccttccaagaaaaccatatctatcagctagcaagctatggtatcatcaaaggaattttgtgagtatggctgctgcataaagttgttgttttttttaatgtttatccagagtctttatttttattcgtataaccacaaagggtttaaaatgtccatgtgttctaggctgaaaacactgtagaagtattggaaggactggtgctccctgatatattatagactgctttaacccatcatactccttctctgatattctaagtttctaagtgctttaaagagacagtgcctggcacagtgtctacattgacaggagtccaggatgtcaaatgcagaagttccagtcccttgcttaacttgttgtttttcctactttgttggttctgttgttcacttggctggcctcataaaagaaccttgtgaagagttcaagagaatgcagcttccagtggatatatttgttggttattttccattcatttctgggaacaagtctgttttctactaatttgatcaagaaaatactgtgctaatgtatttctctaaagttagtagggaaaattttagtcgactcttataactgcattatgtctaagtcatgctgtcaatatacacggcagatgccataggccaacatcataacttgatgaatgatgtttccactccagttgaatgggcaatgagtcttttctaactcttacctaatcattagagttttggaattattaaagaagcttggtcacttttccctcatcttctacagcaaagtgaaataactgattgacttaattatcctgataattcaggcaaaaatacataatcttttttccttatattaatgtcagctccttttcctacatatgaaagaaaattccattatattggtaacactcaattggctctcataccttcagtttttcatatattttgtaacataaaatagaagttatttaatgcaccattttctctagtctattctttactaacactatatgtgttatgtttttcataaaaatatatcaattgatatgaacttaggacattgacttatacgagtgtagtagactgtacttctgttcaaatttaatgtgaaatatgccaaagatttcacatttagagactagttaaaacaatttcagggctcaagaaaatgatgtcttgcaacttcattgggttaggaactacgtggtgatgatgctaagaaacaaagcctcttgaattaatgatacaaataaaatcatttgttgatctgtataacaaattccatttactatttaattttgctcttctgtttagctgtttcctccaattaagagtgccttggcacttttcttgagagagagatctttctacatactgggtaaagaaagcaattttttttatttttttattttttgagatggagtctcgctgtgtcacccaggctggagtgcagtggtgtgatctcagatcactgcaacctccacctcccgaattcaagtgattctcctgcctcagcctccgaagaagcttggattacaggtgcatgccaccacgcctagttaatttatatatttttagtagagacagtgtttcacaatatttgctgggccggccttgaacacctgacctcaagtgatccgcccacctcggcctcccacaagtgctgggattacaggcttgagccactgtgcccgcccagaaagcaattattaaagcagccttccactaacagagaacatacaaagttttcaattaagtaaaagccatggccatattcaaaatactctataaaattatctttatcttgcatatgagatttggtcattaaaagtggaaggtgatatattattctggtccacaaaatgtgtagaaactagtaaacaggctcttacttttgcagttcattatcaaggagtccatagcaacagtgaaaagtatgctatatgatatccaattgcacagcacacctttcacagtttcttctctcttcatctatcagtgaaggcatattttctctttgagtccataatcatgcaaattaactccaactaaaagccaagtcttatttctccagattcaaatctgagagaatttgggtaaatgcacaatagagaaaatcctaatttccaaatattttcatttaagaaacatttaaacttttattatatgccagtcatggaaaaaatatattatttttccttaatatttacatgaagtgggtgctattacaatctctattccacacactcagagagaaaaatcctttacccaaggtctctaactagacagggcagagctggaaatttgatccaggtctgcataattcaaagcccctgctctcaacacagagttccaagaaccatttaataagacaccctttcattcatttacagggaagaagagttggtttgggagaaggtacacgttatctaatgtgtacatgataattttatacagtaaacaactaaaatctgaaggaatgatctgttgaccaaagcacttgcaagtcatccttgctccacggtcttcagcaacaaagtatgccaattaactataaggtataaatcctaactctgcattagtaccttgtttgcagtcactggtgctaatggcagtaactggcaaataaaacctaagtcatttttgccactattttgtaagtaagggaaggtgtttttttgcttcattagtcaattgtcaggaatatagatggtaatgacactttccacaacaccagtgagacacgaatagggcaccttctttaggtctgaatgagacatgtttattagtaaatgaaagcttcaaacatccattccctacatggagaaattcaaacactcaaaatcacccaacttcccaccatgagccatgaggttttcttagaccagggagaagaagactttctgtggcccattcctaagttcctggctggaatcaaggtagacaaattatataaacgttgtaccatttgttgttccaacaaatgagtgaccgttaccatctcctggtgcccaatggatgtaaaactgcattactacagcaatgtggctaatagatataaagttacaggccttcaaatgcttgatttaacacatttttattgggcatacagtctgtgcctaggattgtggacattatattccaagatgtaacatttttctgtgatagatgacccccaaaatatatccatgcttcacacccatgtaagggacatgggtcaggtcaagaaagcaagggaaatggttctcccctccacccctccacctcgaatacagcccacccttctgtcttccttttcctagttgaaagagtagaataggttataaaaacatataaagggaatatatttaatcatcagatagtactgggctgtgtgaattctctttctctacatgctttgagattttctcccaggagaggtgatgggcattgctgagccatcctgtagttgtctttattgtgtctaaacccttcagaccatgaacaccttgagagctgggaactatcttataggtcctctgcctggcacagtgcctggcacagagtaggtattcaatacctgtttactaagtaaatgttggtatgcatcagcaacatggaagatccaacgtaacagaacagcttttaaccatggacagttttttctggcataaagccagctgatcatgagggcattaaacctgaatcttggtctcatacaaacaaccatctgaaaaagtgtccaaatgggaaaattatattgaatccatcaattattta

SEQ ID NO: 698 - DNA, 24323 bp, Homo sapiens
agagtttaatcaaacttctcccccacttgttaacatcagtgacaaaatctttgatgagaacagaatgtttcatacttggctatcaaggattcggggatctagggattatttatggatttcgttaagcacttaattcccatccactgctattgtgaatagctgaggttttgcctatatccctaacacaatttcaaatctgcagaggggctcctatgccctgaagtgctgagcatgttcaggttgtcatgcctatccaagaattctgggttgcacaatacaaaaatatgcaagaagcacttgtgtaggattacagggcaagacaggtgaaaatgttttaaagtgtaggaacatctcactttgaacaatagagctgtttcagaaaaagttcttgtaaaatggatttatgaacatttagttacattttaatcgaccagaggagttgataactcaaggctcactgtgcaatgagctcttttgcaggtgcaaagtatttatgtgaagaaataattccctccccatttagctttttatgaatttgaattttaatatatcaagttgtcttaaaacacctgtatagctaaatctgccaagatgcttttcactgaatatctggtagatgaaggaactcattctcccagggaaatattataaacactttcaaagctgagaaatgcttattgtaaattgaacataaagttttcaatgggccacacctaattaggtttctacgcctcttgaacactcactctccgcatatgggagaaaagcaaggagagcagttcatatagtcaggtttagaagtttttgctttgtttaatgttaaatctatttgttattgtatttatgtatatttgtttctaaatatttatgtatattaagtttctaaatcttgtatctttgcaaatactttaatcacttgcctacagaattttcatttagatccaaagaatcagaataagctcattttcatttataaatttcatctttttctgctgtttatgcctcatcttttctcttctactcctaaacaaaagcttgtgtttttagctcccattttccagatgattgctctgtctttgctgtcatttgtgcagacggcttcagagttcctgcacaagcatatagtgccataaaaataagccagatttttttaaaaaaatgtttaaaacatagtaaatctgcttttgcctactgtttgactttctcttggctcactgcctgagatccattaggtacacttggaatattctagccctggacacgaaggaaagaatttgcttttaagattgctttgtactatttaaagtcagagatgatagtaaccagaacaatggaattgagccttgttgccaagtcttttggtttatggctcttccttggctttggtattcattctcatctttgcatctgagatgagaagtcctattttggttaatgacaacttccctcacacatgcctaatcatccttagaggcagacctggaggctcttttggttgtttaggcatatgttcatttataaacaaaaatgagtgtattctgattcttctggtctaaatgaaaattctataggcaagtgatcagttagtaacctatcccacaagacagggcaggaaaaattagaaatggagagtcatggaagctgactgtattggtggacaccacgttttaaccatagtattgtttgtttctggttcctaagcaccaagggaagtctactagcatgcacacaaagcctcaagaagcttctttacttcaggcatctccttaggccaccttgttaaagaatttactttcataatcagtttctaagaatcagtatttcttttcctattttcctccacttggacataacatgattagaacaaagagttctcatgctttgggactgatcagaatcatcactaaagaaaagactaccaacagtcctaccttcatgtaggaactctgttgttttccctccacttgcacatcataatggctgtgagaaatgaggctctggaggaaatcaattcacatggagccccatcttcttggagggctctctgggaggggcaactgcaccaagatttttgttgaaccatatttgctgcaacgatgacgtgtccatcacactcatatctctcgagaggccccctgggagatagtggcattttgcagtgagtgtggcctattctgggtcataccaaggactatttggatctatctaatttaggtaaataatgatgaaatacataggggttttccctgtcttaagaactggaggatgttttcgaaggctttcttcaatcagtgggagggtacaaacacttgaaagtattcacactggattactgggtaagacaaattgctcatagccacccaggttagaaagattgggatttaacatgacaagcaatcagaggctgaatcgaatggttaaagggtctgtgtccctttgtagaataatcagagattgttaatgaagcacaaaccagaaaaattgttattaggcttgtaagtgctggtaatataatgtgtccaaaaatacatggcaaagcttactctcccttaaaaagacacaaaatttacacaaaaaaattttgtgaaatgtgtatggtaaaatctttataaaagctgtgaaatgtgcaattgatttggaaaagggttaatgccagaatattttaaagctttactcccctccttgcagtgtaatccaaagatgtcttctgttttttccttcctttataaactcaaactcttaattgaaaagcagtctgtgttactcaatatgaatgaaataagtacacttgggtcaggtgtagggttgggttgctttggacagtttaaaaagattctcctcttagcccttatctgtttgttccctgaaggatttctgtatcccttcaggcaaaccaagcagtagcagcagcaataatcttatttacaaagggggcaggagggcagagggctggaaatcccaagggctagtgctcaatatggtccctgtcatcttgagatcagagggtttgccccagcccaggtgaataatgaccaagaacactttgtgactgatgactctgctatgtatggggagttaattgatgtccctctgttccaagtgaataatccactttctagcaatgatggtaatgtcatcaagtgggaaaatacacagccagctaatgtagaaacaagatatagagtccccacccccaccccggactctcttctgggcaagcaggaagtgatacttttacagatacatgcaatgcttttaaaaaatctccgaactagcagaactaggaaaaaagctatctaaactttgacctttttgactaatattatgaatcttctcagacctctgtaaaccacaacgcaggtgcatcaagaacaattaatcaccttagcatctatgacccttggttatctggccctccgccctcatcctcattactctccttcacgtaccatgtcccatacacatgagactatgtgtcattcactggacatatcacactgtcttacatctctcccctcttacccccaactcaccataatttatctccttggagcttcctttatccccatttttccctttattcttttcatagctagctcttactttgtctttagtgctctattcaagcatcacctcttcttcctaaatcaggtatttgtgccctttctagtttcccatagcctcctccattttagcattgattgcactgtgttgcaattatctttttaagtgctcacctactttcattagatcttcagtaatttgatggttcaccatggtggatatatgcacagcacagttcacttatatagaaattggcttatgggtctcaactcagtaacctaatagttaagagtgaatctgagctataccacttactagttgtgtgatcttcagcaggctaccgtctgtcaaactggaacattaatacctcacagagtggctgagaagattaaatgagatgattcatctcatactaaatgagataattcatctcatactaaatgagataaataccaatcattgttatcaatgccaagtacgaggtaggttctcagtaaatacttgctaaattgtattttacagttttcacaatttacacttcactggctatcagagtattatttcctcaatgatgtattctacgtacaagttaaaaataaaagagaagttttgtttttttttttaaataagtgagttaaaatcaaaacaagaaagtggccaaagggctggaaaacttgctactgtaggtgggactaggaattattttagtgcctggctctggagatgaaataaatctaacttcccctcagccactctttcagctatccaaggtgtgtgatgattcatatgaggccaagtaacaaagaacacaaatttaatttattttgacatccagaataaatttgacaaagtttttgaattgctgctgtctggaaagggaaggaaaggaaatagaaacatgtacctcatcatacccatgctcccttgcaatgtggtgtgatggaaagatccagagtttagagacaaaagacctgggtttgcattcaagagcaacttactaactacccatgtgaacttgggcaagatacttggcctctttgagcctacatatgtagaattagacatttttacattatttttactaggcattctggtaggtagaggtggtggttttcatctttaaacttgttagcacatgggaaattttcaataaatacttgtggaatatatggctttaactgaaagaaaagtgaataaaaggaggcactgcttaataaaaataatttgggctttggaatcaggaagtcctgggttctaaccatagttaccttgtctttacctcacagagttttcctttcgcttataacatgaagttaataagagagacatcacaaggatgctgtgagggttaaataatatatataaagtgctggcacaatgcctgacactcagtaggcacaataaaatatagtgtctttgtcctgatcactagctaaagaactggtatagacattattaactgaataagccaaaatgaaatattccaacacagattaattctaatactttacattgttgtagccttttgcaggtttcaaagctcttcaaaacactttataccatctgatgttactgctattttcagagctggcatttttacagatgagaaaatcgaatcaggggttgtggcttgtttgagtctaaacagctagaaagtgagcacacacttctacatttccgctacaagcgggtctgcatctacacagcggtaattcctcctccagtgttctttccaacacagtggctgtctgggtcaaaactgggtatctttgacatttgtcatgattctgatattagccaaaaagattgtgtactcagtaaggaacatatgaacattttcaaatagatcaggcttacccaaagttgtattctattattattaaaataaacacgtgaagtgctgcattagtcatctatttcttagtgttaagagaacaattatttgtttgctctacaaatatttgagcatgttcaatgtaatgaaggaggtgctgcagttaatacttgggagtcccagtgtctgatttttctcttaagctaagattgcaactgtaatattttaatcactcttcccatttgtcaatttcttttgttcatttcccctttttttggatgtgtcacagggaactatgtagtctataagcccaggtatttgttatttaatattacccagaaacttttgaagtggttaagacagtacttaatgaccagcatttctgaggtgttcggagaccaacccattacatatttcacctcctaagctaactagatatataccctccaaatttctcctatcagcattccaggggtagggagtaaaggaacaatgatgatgtgtactgttcattttctaaaatccagtatggagccaagaactttacatgtatcaccttcaatccaggaaaaacttacagaatattctagagatgagtatagaaattttccagttggaaccatccttgaggcaaactggagtttctgcatgtcttaattgattttgtttctacattatcctaaatgtatattccaatatagatagtaacatatattgattgtggattagtttttgagtcttaagatactctatgaagatactaaataagtatctttctctcatcaagtctcagtatgaaatttaagagctggccgggcgcggtggctcacgcctgtaatcccagcactttgggaggccgaggcgggtggatcatgaggtcaggagatcgaggccaacctggctaacaaggtgaaaccccgtctctactaaaaatacaaaaaattagccgggcgcggaggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaaaaaaaaaaagaaatttaagagctaagaatatctatcatttgctttttgttaagaagcattcagcttatgcacccagccagagtttactaaaagaggcagaatgatcgatttttgactatagtcattaaaaagcaaagataatctactctcaatatttcaacataatctattttcaaatagttaattacttgaaaaattaaaatctttcaaaattgactgcaaacacacattatttcagacagtaatatttaaacttcattgtaatgctttcttcattataaaatttaaaggtattttctcttattgttcaaattgaaattatgagtttttacaaactgtgttgaaaagtacttatctcttttctgtggttcaaaatatacagtgctcataaattctttcaatttatattgtactatgtctgttaagtctcaatttacacattatgaatggtatgtttgttttaatttactgcaaaatcagttaaaatctttaatgaaataatgctttttaaaggtgtggtggccttttctgctttattgtgtaaaaaatagctttttgtgtgtttttcctatggtaaaaataaatagattaatccaatatgtccccacttttcaagtagtcattagtgctttttgaggaataaattagttcagcaatcttttagaaattaaatccttagtattttgccatcagactgtgaaataaggcagagttcaaaggcattttatgttcttcatggtaatctagaatttttatttgattccaggtaactttggacaatagacatgatgagatgttttctctttgaataagttaacagtttaattacattgaaataaaatatactgtgggcttaatacattgtaaatattacagaagaagtactactttgctatagtaatttaatgactgaagctacatttaataacaatcttaccagtacttgtatacaaagtattatacagattactaacgaagatattgcagtggttgcaacgatgttaccagctcaacaaacatctaacaatacaatattcttctaagaggaaaagtaataatgttagatttacagacaataaagagtcatgtttcccgcttgaaacattggaaataaatttgaatccagatacaagaaaaggtttcctttcttgggaactctgatccccagtaggcctagtacagtcaatttacatgaagatagcttttaagatgccacggcaatgtaaagaaactctcccatccgaaaattactgatttgtaggccactgctcaaacatctgactttttagaaacctatttacatacattcagcccaaatcagtagatagaatgtttttttctatattacaataggcattgttaacatttcatcagaaggccagtgcaagacaattaattgttaatagccattgcccagcatttaggagattttaaaatatcatacaaatatacagttagagtgtgagaaatctaattgtgtgcatgatatgggtggtctcttttatggacatgaaatggcagaaattaatcaacaggacagtaactatagcgctactcatccagggcctaattctcatctggtggttgggcctatttcctgcagagtggatttaggcagcaaaaggtccttggcatttaataccagatagacttaactcaaagtgccagagaggcttggaaatcatctcaagtgtaggacagatgtctacagcatctctcagattcatatcctttcacatatatttcatacaaaataaatcagaggttcctcttggaggcagccctacttgtgcaaatgaaacattctaggactgattcatcatgactctgataaaaaaaaaatgagcaggttgggaatttggccctttctgaacatgtgtgatggtaaaatgcatggtcagggcaagtacatcatcctcagaggaaagtaagatacctctgatgtcagaccttataaaacttacttaaatttaaatcatttaaattaatggatctaattatggggttaattaatgagtgatattaacaaatggtaattctaatgagtatattcattggggacaatgttttcgtcacttgggttaagaaatgatatgaaaagtgtcaaagtgaatctaactagttttaaacctttttaaatgaaggttgtataacatacgtgatgatatttcacagatatttcttagaatatcaataagcaccaagtttagtgctgtcagccccattgtcccttaatttattatatatgatttagatcttgaaagcacaacacactataaaatctacactgcatacgcacaaatgcagtttcaaaaatgaatcgtgaaatttttctaccataacaagaatttctctagctcttcatagctgtgaaaagagcattggtactgcctggtgagctctgaaacatgtggattaatgttcaagatgatgcaggacaaaagactggcaattcttaaatgcaaactaaaccctggtgagttcttcttgtaaataatctctcctgtctttagaaagagatcttactaatcctctagcaccctgagccttcatctgcacatgacagagaggtaaagtaagggagccagcaggcagattcaaggtgtgcagacagacaatgcaaagtatctcataagccacatcctgccttagagcgtgaaccgtaagaaggggaactgccccatcaggctgcttgggtatctcgagagctagaaatcaccagatagatgccagctctgtacttcacttcagactatgtaaaccttggggccttgtaggagtcatgttttatctgtataagaagagattataattaaaatttgtcagggttaagtagattcttcagcaatatcattccttactggaaaaaggcccaacaagcacccatggcgccattaaggagcatgagaccggggtgtaagaagaaagcagctgtgtttatcttcatgcttgagtgtatcttgctaaccacgagcaaaggagagatttgttccttagcccaaacctaccaagacagagctgggtgctcagctgtcaccaagggcatgtgggcaaagcacagatacagcatagctagacgtcaatgccaagtgtatcggttcttcactgccgttgtgtgtctcatccactgtctgattcagcttttttagccacatgggctgggtgtgatagtcctactttaacgtgatgtatatagtgcatactatctacacacgctattgaaaaatgttaccattgtttttctgtagaactgtcttccttttagtgactgacatattgctcaatattcggtgctcagaaaccaaagtactctcctttcctggcaataacactacaaatacatcccttccttggatgcctgtcattattttttgctaagcactggtcttgtgtaatacctaaaggtcaatttagtaatacttgatccaatctcttaaggagggatggggtgaaatttttgaatggttggagtcagtatttttatcaacaagattacaggaagaactcaattttagaaactgaatccatgtgcaagagtgcagcaagtggtaaaagtttatacttggtcacagttttctcactttatgacattactgtaacagttacaggacagaaacacacatacacacatttatattcacactcacacacagtataattttactgatccagacactacttcttttcaattaaaaaaaatgaagactgttgtttggccacccaggcatgaaatctacttaaacctggaatataggaacacaatactattcaagtaaacagcaactgcacagtgataacgatatacattaagattaacacatgctgtcttaagagatccagtaatagctaaagactaaagaaagtcagagatgtcgctcaaaaaaagtcaatatgctttctctcttccattctgattataatccattagaacagctatagtccagaagataatgtgtcttcctatgaaaatgcagggctaataaatttttaagtatgaatgaattctgctcaatattttgaagtcttcaaattcttcttgttgaggtaacagaaaaataaacctttacggttatttcagtgtcaaaattaaatagagatatttgaagaaatattaaggtttatttctaaagttatatcatgggcaataatatagaaaaaaagtgcacacattgacacgtatccactgcttgtccattgttctcataaaagtctacctttcagttttgctgaactaaacaaatattaatagcacataaacactgatacacatctcacaggacataatacattttacaaaatatctctagtactataacttgtaaaaatggacatctctgatactacggacagttacatttcacattatagtgaaagttgtggttacaaaggcattattcatttgatggcatttttccatgggttcttagacttccaattgtgtagccaaaggtttccctcctatttcattgagactttgaaggatcgttcagtcacttaaacaacaggctttcttcactgtaaacccctggagaatggagtttgagtacctaaactatggaaacattagcaaactgataagtgatcatggtgacaatcaccttttcattgagcatggtaaagttaaaaaaatataaccaaggagacaatagactcttctagattttgagcttaaaaaaaaaaattcttttcctgtgctgccagggaggcatcaggctcacagagcctcggcagacgtgtctgtggacacagacatggttaccttggcaatcttgaccgtgctcttgatgcagctttctgcggccctgtgaacactggctgcattgtttgcgtgtttgtgcaggcagtccgagtcccccatgctgttatccagaggctgcgcagtgccttcacaagagggaaacatgctccggaaagcgtgtcgcaggtccttactcctcagagcatagatgatggggttcacggtggagttcagcaggcagagcatactgcagaatgcaaacaccgtcttaatgagcttgttcatcttcccaaagacatcatacaccatgattgcaagcagagggccccagcagatgatcaacaccaccaggatcaggaccagggtcttggctaacctaatgtccatgcgggcttggtctggccgggtcacctgtaccttcccatcctcagacgtgtggatgatgatgctcttctgggtgccacgctgaatcatgcggacggcgtggctgtgagccttccagagaatatacatgtacgcatacacgatgaacagaagcagtacgctggtgaccccgatccagaacatcaggtaggtttcatcaatgtgtgggaaaatgtctgagcaaacagattgcagtttctcgcagttccagcccaggagaggcagcacggcgatcacaatggctatggtccacatcaggcaaaacgccaccacggccttgggcctggtgacaatcctcttataggccaggggcctgtgaatggatatgtacctgtcgatggctgtgaggaacaggctgcccacggaggcagtgaaggaggccgtgaccccacccagtttgaacagaaacacgttgcggctatctttgcggtggaacacgtggaagtcaatgaagctgtagacaaaaatgacactccccaggaggtctgccaccgccaggctgccgatgaagtggtaggaaggcctgcagcggaggctgcgggagtggaggatgacgcacagcaccaggaggttctccaggaccgtgaaggtgcccagcgtgagggacaggactgcaatggccagctgctggctggggttcaggaccatgaaacactctatgtccatgaagttctccccacactggatgttctcctcattctccttgaaggacgagagagacttgttgtaaaattctgtaatgttcacctggtctgctgggactagctgggggttgtctcccgcagtcatcttctcttggaagggacttcccctaaaggaagttaaagggaatttctgtgggaagtaccctaatttggatgccatgtcacctttgatgtcttcgtactgaatgtcatttgagcccacgtacaggaggtcagtggtgatggtgcggaaggtggtatctgcaaggccatctaggatcgacttcataacctcagtctttgattaggctgagctcaaaatgactgagaaagtgacccacagggggcaatcctaagaggagggaaaacaaataagccgaatggtgagaaacaggaagaataaaaacaaagagacactgtaaatgtggcaaatgtactgtcatggcaactcattcctgtctctgaacagtaggaggtcaagttctcatcagattcagtcaacaaaatgagtaagtcactcagagaaaagctccccaaagttcagggatggcgtggcacatgccagaaatgtatcaccttttcattatttaaaccctctgtattgaagtcagtgtgtgaatccaggaaggacctccagggccaagaagactgaactaaatgaaatgtttcttggggacaatgtccatttcatagtcacgttaggaagtgtttagcacctggcttctcctgtcacacacacatggtatcccagtgctggttggggccggcgagagcactgatgtgtcacatgacccctactcttggagacttcaccttgtcagacaaatgagactaaatgtaaaagacaaccaaagaataagacagtgtagaatcaagtgatgagttgtgtggtctgtatgttacttgtagcgggggaggagggagctagtgagaactgaggaagcttgaggccatgtggggagagatgctcctcaagacaagtttcttcacccagagaaggggaggtctggacggagccatggctgacatgacttctaggatgtccacatcaaccaagaaaaatgtcacaaagaccaaacttgcaatgaggcgtataggaagacagagttttttttttctttctttctttctttctttttgatacagagtcttgctctgccaccaggctggagtgcagtggcacgatctgggctcactgcagcctccacctccccagttcaagtgattctcctgcctcagcctcttgagtagctgggactacaggtgcgcaccaccatgcccggctaatttttgtatttttagtagagacagggtttcaccatattggtcgggctggtctcaaactcttgacctcaggtgatccacctgcctcggcctcccaaagtgctgggattacaggtgtgagccactgtgcccggccaagactgagctttttcacagcagggatatggaggaggcctcctgatagtccccttcatgagcaggttggtgacacaagtgtgcctggtgacaggagacaggctggagagtgtccaaggatttccatgtgaacagctaagaggaaaggcccaaactttaaggttcttcgattctaagctaagcaatttggttttgtttcaaaataaacagccagagaactgatcttactatttataaatttttgtttaaaatgtgggctattcatttctttagtttatttttaaaaattagaagtatagagtgatatctataacaattaaaataagaattaaaacaatatattacttgttaattggcatttgttgttcctgaaacatatcacactgtatggggttgggggagagacaatcactatttcagaacaaattttaaaaatgttgaactaacaataaatgagttattaattcagagaccctaatatctgaattaataattcatttattcatgtattaacaaattatggagcatccactatgcacttgtattatgtctagctacggtactagacactagtgttgacagcatcaagaaagagtccctgcccttggccgggcacagtagttcatgcctgtaatcccagcactttgggaggctgaggtgggcatatcacgaagtcaagagactgagaccatcctggccaacatggtgaaaccccgtctctactaaaaataaaaagaaatttaaaaaaattttaaaaaaattagctgggcatggtggcacgcctgtaatccctgctactcaggaggctgaggcaggagaatcgcttgaacccgggaggcggaggttgcagtgaggcgagattatgccactgcactccagtctggcaacagagcaacattctgtgaaaaaaagagtccttgcccgcatgaaggatatgatctagcagaggaggcagacagctgactcagaaattaaaagaaagcatggggagagctacaattggggacgtacaggatgctctggggacacccagtctagagggctgaaggaggtttccccaaggaaaagatatttatgctaagaataggtagcatcactgtaggtggggacaggacacagagtcaatgaaaataattttatttaataccctagtgtcatgattcttaagaaaagtaatttggaacaggcataaagtgttaaatgtggcccaccttcccacattctgccacctccacttccaggatctcatcactgctcaccagggttagggcgcctgctttctgaccagttttcctgctcttctctggtcctgttcctttttgatcacttgccacacagctgtgggggtaatcttcataaacgtatgctgattatgtgactcccctctttcaatctctttgccctaaaaaccaaatataaactttcacgcagtttccttttcaggcccaggccctccagacatgtatgcaactctcgtctgccttctatgtttccatccagctgagctcctttccaattctgaccctcaggctcttgtccttaatactctccacaacctgtctccctaaacaggatggctttctatctcccacctgcaggatgaagtccagtaaaaagtttcctgtgatctagctcccgcccacctctccaatcttcttcttgccagccctggccttgccacttgggctacaccagatgaattttagttccataaacacagcaaattgactgctcctcacctcagtgctgttgctcccattgccccttacactcccgcctggtcaactcctccccatcactttgatgtcacttcttgccatagctccctgcttcccatggcgatgaacaccctttctgggctcccagaatacccaaacagagttctatcatggtactgaccagattttctaatacttctttgtgtttgcatctgttccactacttcctcccacccactagacagtaagttcactgaagatcttactggggactttatcttagtatctactcagcatttagtagaatgcctaacacacagaagaaggctccaaataagctggttgattggatatacgtatttcaaaatagaacaaaaacaagaagctcttttctacccaaagaaggggaaggattctcccaatgctgattaaaaaaaaaaaatgatcatgtaacttgaatcaagggatctagcctggagagctgcccaatccaattgtgctagaaatatgctctatttaggtaaggttattagcattttaaatgaagctgcctatataattatctagtctaaactctcatggaatgagctatatgcaataagcaactttggctacagagaggcaaacaagaatattggcaatgccataccaaatggtgaacagagaaagagccctcagcactaatgtgacaggtaagccagaaggctcccttagctcctccatggttgtgtaacccttttacaagatcactgtagcctgtgatggcagtaggaggcactgccaaactgagggccccgaatctcccatgggtaacttctatcatcactaagaaaattgagggttttttttagtctgggcttctgaaccagttctgcacacctttcctgcaactgtcatagaataaagcagatgggagccatcacctactggaccagaggcaggagctctaaggtacaagccacacagaggcacccagtgtgctggtacagtctgctaacgccaatcaagtcaaggcagtgtctcaggggcaaaggctagtggctatagaaataaaggatgcagaaataaaagaccaaagaccaacagccaagccagttgcccagtgcttctgggctcctttatctaaaatatctcctgagttcctaccctcagcctggctccaatgttaactctcgagtatccttagtatccttaggttccctgttcatctgtctgtctgtcatatcttttctcatatcctcacctcttctagaacatgctctatatgtcccacattcggctatttctcaggagtcaactcttgctccttgcaaacttatgtttgcttaacaactccatttacatatggaaagttttcatccataatcaaagggacacagaagacagccacaatgtgtgagagctgttccttacatggtccttgcacatccacaaacctaacttttgcctttcgactcccactcatacttaaacaccaggcttactggccctgagtgacttgctgctctttgaatacaccgtcatacctgcacaccttcctccttcaccttgtcccttcttttatctggatagaagctctctgcctactaaacttatctttccaggtctgtgccaatgctacttccatgtctgagaccttcctgaccagcccctcccactaggtataactagttccccagcacatccctctattacaggcctcatcacgtcgtataatcaggagttcacatatttatttccataactagaatgagatctccaaacacagaggcatctttttttcttaagtggtttaccagcctgatagcatgatagcaggagagcagacagctgagttcccacagaaatgttcacctgaacctaataaaatggcagttgaatttttattaggtggtaccttaaaacagtgatttgcatttgcctttttcttaaaattagaggacagaaaaaataatttatgcaatagacatttagcctgaaaaccagagtttgagcctccatctccaagtagctcctgtgagccattccagtcatcttcccattccttatgccatcttccctcaattaactaactccccctttacactttccaactggaaactagtttatcagaaattttgattatctttatgtattagattcacaagatttaagattcaaaaggtacagaaagacatacagagaaaagtcaatctctctcatccctatatcccagccacctagttttttttctcaaaggcaaggagtaagtttcttgttaccccttccagagatactccatgcatattcaaacaaatatatgtatttaccccctctttgttttctttttagcaaacagtaattaacattattatacatacctttcttttcttcttagaagtacacattgtgaacagttccatattcgtatataaaacctctctcttcattcagctgccttaaggatctgttagatgaatgtgaccagcctcctactgatggaggtttaggttatcatcttttgctattagaaatgatgctgcaataaattgaatccaaccacaggtcactcagcaagtcactcaggaccagtaagcctggtgtttaagtatgggtgggagttgaaaggcaaaagctaggtttgtggatgtgccaggaccatgtaaggaacagctctctcatatattgtgactgtcttctgtgtccctttgattatggatgaaaactttcatatgtaaatggagttgtttagcaaacataagtttgcaaggagcaagagttgactcctgagaactttttcacatttcttatggcattgtgagtagtctttctagtcacctaagttcctaacttggacttactatgacacctcctctttcttgacctctacaatcaggtagaccactaagtcttgctgattttcctcttttaagcatatagagagagcttcttatggactggtgacactgagcctattacatatatatcaattcctttatttcacaatggccctatgaagtaggtgctattatccccattttcagaagaaaggcacagagggtaagtaagttgctataggcaaagctagtaagtagtagagcaagcactgcacccagatgagagccacatttcaagtccttaatagctccatgtggttagtagctactatactggacagtgcaggtctagggcccttacttgtagctttttttgatacaccatctctctaagctaagacagggatattaccatcttccttgttttcttcactgattccaaccagtcaaagcacctagtcaatggaattaggagttagcagaccaagattggtgttagatggtacttgggcaatcagtctttctaagcctcagtatttcatctgtaaaatggggatgaggatgatgacaataatgcctaaatcgcagaactgatctgaaattagatgaaattaaatgcatgtaaaacatagtgcctgacacaaaagtaagtcttcaatgggtattattattatcattacttagtattatggctctttgctatatactatatactaattatattgtaagaatatattataataatataatacatactaattatatctcaagaatgctcattgccttaattattcaatcttatttttgcctcagcacttaaaacatgaagcaaatagtagatatatatagacatgggtaagggatggggaacctttattgaatgtctgttatatccagccatttgagaaactttacatatattctatcattaaattgtcaaggcaaccctatcaggtgcttatttataatccccatttcacagatgaggaaatggaggccatcagatgttaagtaaattgcctagaatatgatggatttgcagatgaatcgaagtttctcagactccacagtctgttttgagattttatgtgacgatttcagaattaacagtaactaggttaaagccattttgcatcttatatttaagtcttctggattcttagaaatgtgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaatgtaaattaaggcattttgccaatagtaattaagactacctgctactaaatccctatttcctatcaaagctcatctaggtaagtctacctacttgcatggacctaaagattaaaatttagtcactacttggaagagctataaagcttcttcagtgaagacaaaggatcacatatcttattccagtaatgcaaaaaacatgtttctgtgacttactttagattaagatcaccgcaagtgtgatcacaacttcccattttaatgcaaccaagcactttcattaaaacaaactagcttgttaaaatctaagctagggcatgggtgtggttatatgataacagagtaatttctgtccaatataagccaattgaattaaagaatacagttaataatatatggattttatgtagttcaaagatctcagtaatgtcgaaatactactgtgcacaggctattttaacagttaatgggatcatggcaggaaaactgctctctgcattttgataattctttcctttatttctacatttggattattacagtaatttccaccttattattttttgcatcaacaacttcctttgagagttcattactaatacggcttaggctttgggggatgtagctgccattaattttgtttttgtttgctactaggaaaatcataattggaaatttctagcaagatgtatagatgcacctattaaagaagcagttggtttttattacagttatagtaaaagaatgattgaatgacatataagggaattttcctagaattctgctttaaaaaatatagccaacatattctaacagtgtaagctatataaatcatgacttcatagtaaagataaaaatatcttaatgtattaaatccattatttttaaaaaatcactccaatttttagactatcatctattctttttgtctatttctctgtatgcaaacctgcctctccactacctccttccaagaaaaccatatctatcagctagcaagctatggtatcatcaaaggaattttgtgagtatggctgctgcataaagttgttgttttttttaatgtttatccagagtctttatttttattcgtataaccacaaagggtttaaaatgtccatgtgttctaggctgaaaacactgtagaagtattggaaggactggtgctccctgatatattatagactgctttaacccatcatactccttctctgatattctaagtttctaagtgctttaaagagacagtgcctggcacagtgtctacattgacaggagtccaggatgtcaaatgcagaagttccagtcccttgcttaacttgttgtttttcctactttgttggttctgttgttcacttggctggcctcataaaagaaccttgtgaagagttcaagagaatgcagcttccagtggatatatttgttggttattttccattcatttctgggaacaagtctgttttctactaatttgatcaagaaaatactgtgctaatgtatttctctaaagttagtagggaaaattttagtcgactcttataactgcattatgtctaagtcatgctgtcaatatacacggcagatgccataggccaacatcataacttgatgaatgatgtttccactccagttgaatgggcaatgagtcttttctaactcttacctaatcattagagttttggaattattaaagaagcttggtcacttttccctcatcttctacagcaaagtgaaataactgattgacttaattatcctgataattcaggcaaaaatacataatcttttttccttatattaatgtcagctccttttcctacatatgaaagaaaattccattatattggtaacactcaattggctctcataccttcagtttttcatatattttgtaacataaaatagaagttatttaatgcaccattttctctagtctattctttactaacactatatgtgttatgtttttcataaaaatatatcaattgatatgaacttaggacattgacttatacgagtgtagtagactgtacttctgttcaaatttaatgtgaaatatgccaaagatttcacatttagagactagttaaaacaatttcagggctcaagaaaatgatgtcttgcaacttcattgggttaggaactacgtggtgatgatgctaagaaacaaagcctcttgaattaatgatacaaataaaatcatttgttgatctgtataacaaattccatttactatttaattttgctcttctgtttagctgtttcctccaattaagagtgccttggcacttttcttgagagagagatctttctacatactgggtaaagaaagcaattttttttatttttttattttttgagatggagtctcgctgtgtcacccaggctggagtgcagtggtgtgatctcagatcactgcaacctccacctcccgaattcaagtgattctcctgcctcagcctccgaagaagcttggattacaggtgcatgccaccacgcctagttaatttatatatttttagtagagacagtgtttcacaatatttgctgggccggccttgaacacctgacctcaagtgatccgcccacctcggcctcccacaagtgctgggattacaggcttgagccactgtgcccgcccagaaagcaattattaaagcagccttccactaacagagaacatacaaagttttcaattaagtaaaagccatggccatattcaaaatactctataaaattatctttatcttgcatatgagatttggtcattaaaagtggaaggtgatatattattctggtccacaaaatgtgtagaaactagtaaacaggctcttacttttgcagttcattatcaaggagtccatagcaacagtgaaaagtatgctatatgatatccaattgcacagcacacctttcacagtttcttctctcttcatctatcagtgaaggcatattttctctttgagtccataatcatgcaaattaactccaactaaaagccaagtcttatttctccagattcaaatctgagagaatttgggtaaatgcacaatagagaaaatcctaatttccaaatattttcatttaagaaacatttaaacttttattatatgccagtcatggaaaaaatatattatttttccttaatatttacatgaagtgggtgctattacaatctctattccacacactcagagagaaaaatcctttacccaaggtctctaactagacagggcagagctggaaatttgatccaggtctgcataattcaaagcccctgctctcaacacagagttccaagaaccatttaataagacaccctttcattcatttacagggaagaagagttggtttgggagaaggtacacgttatctaatgtgtacatgataattttatacagtaaacaactaaaatctgaaggaatgatctgttgaccaaagcacttgcaagtcatccttgctccacggtcttcagcaacaaagtatgccaattaactataaggtataaatcctaactctgcattagtaccttgtttgcagtcactggtgctaatggcagtaactggcaaataaaacctaagtcatttttgccactattttgtaagtaagggaaggtgtttttttgcttcattagtcaattgtcaggaatatagatggtaatgacactttccacaacaccagtgagacacgaatagggcaccttctttaggtctgaatgagacatgtttattagtaaatgaaagcttcaaacatccattccctacatggagaaattcaaacactcaaaatcacccaacttcccaccatgagccatgaggttttcttagaccagggagaagaagactttctgtggcccattcctaagttcctggctggaatcaaggtagacaaattatataaacgttgtaccatttgttgttccaacaaatgagtgaccgttaccatctcctggtgcccaatggatgtaaaactgcattactacagcaatgtggctaatagatataaagttacaggccttcaaatgcttgatttaacacatttttattgggcatacagtctgtgcctaggattgtggacattatattccaagatgtaacatttttctgtgatagatgacccccaaaatatatccatgcttcacacccatgtaagggacatgggtcaggtcaagaaagcaagggaaatggttctcccctccacccctccacctcgaatacagcccacccttctgtcttccttttcctagttgaaagagtagaataggttataaaaacatataaagggaatatatttaatcatcagatagtactgggctgtgtgaattctctttctctacatgctttgagattttctcccaggagaggtgatgggcattgctgagccatcctgtagttgtctttattgtgtctaaacccttcagaccatgaacaccttgagagctgggaactatcttataggtcctctgcctggcacagtgcctggcacagagtaggtattcaatacctgtttactaagtaaatgttggtatgcatcagcaacatggaagatccaacgtaacagaacagcttttaaccatggacagttttttctggcataaagccagctgatcatgagggcattaaacctgaatcttggtctcatacaaacaaccatctgaaaaagtgtccaaatgggaaaattatattgaatccatcaattattta

SEQ ID NO: 699 - DNA, 2377 bp, Homo sapiens
cacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaataga

SEQ ID NO: 700 - DNA, 160980 bp, Homo sapiens
attttctggacatctcacactagtttcaacttaagattaagtctcatcaggcagttgacctgtagagagctgtaagtgttacttctctcctacaaaaatttttacaaatcaaactatcatgggatgtaagttttgaaaacacaaagtttcttagaaataaaactattactttatgataggacagataataaatgataatctggtccttaatctacctgcactgtttggagagatatggagtcaataatctccctatgttataggagttattaagaaattattttaggcagatagagaagacaaggggtccttggcaagtttcttttcttttaaggcagctccagatacatttcttgcatagcagaaaaatggcctgaagggcgggccagcaagctttgatatgcaaatgccagccattagaaactgggtccactcaatatggcaattcccaccttcttcttgtcactacaagtgcctagcatcatggccacccccacatatccccacgtgtgtagaacatcatggtgccctgcatttgcatattaaaaggctagggtgggaggaccagatttttgtgggctacatgaatgacatacctggtcaacccaatcccctggactctatgcaaatcagacaccagctcctccagcctcctaatataaatggctgttttctgctgcactcagggttccctctctcagcttggagccccctccctctgtctctgtatgggggagccccttccttctttcttgccgatttattaaactctctccgctccttaaaaccactccacgtatatccatgtcgtcgtatttaaactggcgtgagaaaaggaccctggtattcccctccagtcatcagagtcgtatcattttggtgcactggccgggaatccgaggtacaacattcactgaagtggtgattatacaagcgagcttaaaatctgttctatcattctgaggtgctcttggcctctattttaaaatcaaatcaaatcaatcaaaaggcatctatctgtctgctggttagctacacttatcgttggctgctgttctaaagactcagatgtgaggcttgctggtgagaacatggagaaccccccaatacccacaggtgattgggaatgttggccgtatttcgaatcagcttcctttcatggggagacctcgccgttgcgcaaggctgggaaaagttctgaggcaactgagcatctctgggcagggcacaccctggtgtgactcaaagacctctggaccagacccagcctccaacagcccatttcaggtgctggcagagaatcctcagctatccggtcatgaaactttccttccttttctatctgtggtctcttactctgtgtgtatgtgtcaactgtgtgggaatttagtaaccgggagtttaactcaagaatgccattgcaatctcctgaacagagggttcctccgggacagtgagcctctctctctcagccccttggtctggagagcacacggcatttccaggtctctctaccgcttgtctgaggagcacacagtatttctaagccaacagtgccacctagaggaaacagaaatcctctacatgaggcactttttttaatgctaacactgcagcttccttttgcactgctagaaatcaggctctaagcctcttccaggaatgggaaaattctgctttcaacagttagaaattaaatgtcttccatagccaaattttagtctcaatattgtcccatcagcaggaaaacagccatttggttcctacatttctttaagtcacctattctgtctccaacagagacagtacttaattagtaaggggattttaagtctggaagttaactgaaaccatttttctaagggtaaatgctttagcatgggccataatagcaggatatagagttcaatctagcataacccctccattaaaggggccttccccaattacacagttttccctgagatccatttttttttagggaggtacacaggtcacacaagtctaggaggtcaaagggaaataacaagcagaggactgggactacttgggtaagtgtgactaggcctcaaaagtctagtttctctggtgccatggcttggagggtcacacctacagccacaggcggcacatttaactgggtgccgggacccaggaaccagggagggagactagttagaggaatgccccctactgttttcttctccaccctgagtcatacaccaaaaggaaggagactaaaaggacacttttattctcacttctctttctagatggccaacagatcgtcttcagcatgcactcctctggaatgtattttaaagcactgggactccttcaaccctgagactttgaaaaaaaagtgactcatattctattgcacaagagcatagccttcttactatcttggggacagataaacctggcccgctgcggggagccttgattttaatattatccaacagttagatcttttctccaaacagaagggcaaatggactgagatcccctatgtacagactttctttgccctgtgaaacagcccagacctttacaagttctgtacaattgacccagttcttttagcggccacagggaatcgttccccagagctaaagcaggttccagaggagcaatctgaaacagctattgaatgtcccaatccttccagtccccctccaatcatactatcagctcctccagctccactatctccagtatatcctactctccccgcttcattcttacctctgcaggaaatggctgataggaatggtgccatgagggttcaagtttccttctcattacaggaccttaagcaaataaacagagacttggcccaattttctgatgactccgataagtatatagaaattttccaaaatttaactcaggtgtttgatctcacatagagggatgttatgttgctgctaagtcagaccctcactggggctgaaaagccagcagttccacaggcagcagaaaaatatggatataagcaacatgcctcctgtagcagaccaaggagaaaaagaggagacaaggaaggtaaggaagaagtggaaactccattcccactaggaagggaagcagttccagcggacaaccctgattggaaccccaataacgcaggaaatgaatggaaaaggaagcacttcttaaggtctatgttagagggcctatggaagaccagggccaaacctctcgattactctaaactatctatgatagaccagatgagaatcccacagcctttatggaaaggctaagagaggcactaataaaacacacctctttatcatgattcagtcgagggacagctaatcctgaaggacaagtttattacacagtcagctcccgatattggaaagaaactacagaaacaagctataggaccagatagcaccctagagaacctcctgagaatagccacttcagtcatttacaatacagatcaggaggaggcccaagaaaaggaaaggaaatataagtgaagaacagaggctctagtagcagcattgcacgcttgtaaagtccaggatccctgaggtgcatctgctagctgttatcaatgtggcaagtcagggcattttaagagggaatgcccaggcagcaagacgaagccaccttgaccctgtccagcctgtggcggagaccactggagatggatctgcccccagaggcagaggtcgctgggttcagaaccagtctcatagatggtccagcaggactgacgggtcccgaggcttaaacccccggctccagcgactcagactgccattacagcacaggaaccctgagtgattctggaaattgaaggaaggaaggtagatctccttctggatactgaagccagtctcttgctcctcctctctaattcaggcctcccctcttcccagagcacaaccataaggggtgtatcacgaaaaactctaacccaatatttttctcaaccccttttgcagatggggagacttactatttaaacatgcctttttaatcacgcctgaaagtcccactcctttattaggtagatatattctagcttgcatgggggcctgcagcatctttacagccccaggacaaactctatctccccctgatggaagctaacattaatgtggaagtgtgggcaacttaaggaagaataggttgagctataaccactacgccagtccagatctatcttaaggatcccacttcttttcctaaccagagatattatccctaaggccagtggctaggaaagggctagaagccattattaataacctaaagatgcagggcctcctcaaaccctgtaatagcccctgcaacaccccaatattaggagcacagaaacccaatggggaatgaagcctggttcaggaccttcgcctcattaatgaagctgtagttccaatccatccagtggtccctaatccctataccctgttaactcaaatacctgagggaactaaatggtttacagtcctagatttaaaggatgcctttttctgtacaccgttacatcctgactgtcaataccggtttgccttcaaatattcctccagccagacgcccagttaacactgacggtgctgcctcagggattttgaaatagtcctcatctgtttggacaggcactgtcacaagacctctctgagttctctcaaccttaagttaaggtcttgcagtatgttgatgatattctgctatgtgccccaactgaggatgcttttcaggaaggcactgaagctcttctcaatatgttagctaacagagaatataaagtttcaaaacccaaggcccagctctgcaaaacctcagtgaagtacacctaggcttagtgctgtctgaggggaccagagcattagggaaggagggagttgagaatatttcttcctttcccctccccaaaaccctcaagcaactcagaggattttggggcattacaggattttgtagactatggatacctgggtatggtgaaataggctgtccatgatataacctcataaaataaactcaaggaactaaaactcatcttttaacctgggaatctgaagctcaaaaggcctttgaccagctaaagcaagccttgcttaaggcaccaactttcacccttcctatagggaaggacttcaatctgtatgtatcagaaaagaagggaatggccctgggagtattaacacaggcccaaagaccaggccaacagccagtgggttgcctaagtaaggaacttgagttggtggctaaaggatggccagcatgcctccccgccattgcctcagtggctctgttggtcccagaagcctccaaattaactctggaaaatgatttaactatttatgccccacctaacgtggcaggactactgcacttttgggggagcctttggctaacagatagctgacttcttaaatatcaggccctgctgttaaagggttccaacatccaattaaagaattgttctcacctaaatccagccgccttccaccaggaggaaactggggaatctgagcatgactatgaacaaatcatagtacagacctatgcagccagggaagatctcaaggaaactcccctagagaacccagactggaccctcttgacagatgggagctcttttgtagaacaaggaatctgtaaggcaggatacacagtagtcactctacatgacatcactgaaagtgtgtcactccctccaggcacaagcgctcaattagctgagctaatcgctcttacagaagcaattgaattaagcaaaggaaaggtagctaacatttacacagactccaaatatgctttcctggttctccatgctcatgctgccatttggaacgaaaggcattttcttaccaccgatggatctcctataaatacctccaggaaattaacaggttattatcctcagtttttcttccatgagaaatagcagtgatgcattgtaggagacatcaaaagggaacagatgaggtagccaaaggaaacagattagctgatcaggcagctaagtcagcagcaaggaaggctcaagacaacacacttcaaacccctctaatctgggaaggctccatgagagaaattaaacctcagtactcccccacagaaataggatgggccacttctcgagggtatacatttcagccctcaggatggctacagtcacaagatggcaaactccccttgacggcctccagccaatggaaagtccttaaagtgcttcaccaagcttttcacttgggagaggataaaacttatcaatgtgcccagagattgttttcaggaaagaacttactaaaaacaatcaagcaagttgttcatgcttgtgaagtctgtcttaaaaataatcccctgaacaggcgactccttcctcctcaaacccaaagaacaaaaagatacccaagggaggagtggcaggtaaacttcacccacatgccaaagacaaagggcattcaatacctgctgtatgggtagataccttcactaactgggtagaagcatttccatgttgtacagaaaaagcctctgaggtaataaaagtattagttaatgaaataactccctgctttcatctatccaagtaccttcaaagtgacaatgggccctcatttaaggcagctgtcacacaagggatctcaaaagcactaggcatagaatatcatctccattgggcttagagaccctaatcctcaggaaaggtagagaaaactaatgatattaccaagagacacaccagaaaattgtcccaagaaactcaccttccttgggtcactcttcctcccacggccttactacgaataagagataccccttgaaaattaggtcttagcttttttgaaatgctgtatggacacactttccttaccaatgatttttctattagatcgggaaacctctgagctagttaagcatgtaacctctctggctcacttccaacaggaattagcacaattagcgaaaacccaatcccaggaaattggaccacctctatttaacccaggagatttggtactggtaaaggatcctcctctctctctcccttcctaagcccaacctaggaagggcctcacactgttcttcttccaactcccccaacaataaaaggtacaggaatcgaccgactcctggaaacatcacactcaagtcaaagcctggagagctgagggagcaacccccaacagcccagaggaacgtcctgaatagcaatgtgaagaaatggaagatcttaagctgaaaatcataaaagataagtaactatatgagaactaatcatcttattcagtctcacccctacctcaacaaatactttttgtcatttctacctctccttttgagccaaatatcagaacttctttttggtggaaattatttactactccaaccttgcaggaattgctatactcactctgctatttgcagtagaactatatactgtagcaccctcagggtggaatgtcagagagagaatctcaattactactgcattttgcttaattattaacctcacagcaggaataacagttactaacaggaagtaaacatgagcattttactatcactaaatctgttagaactctttattggacttagtaatacgtcgcaccatctagctcctacaatatctgccatggcccatttgtacagtaagactaattgttgggtctgtcctaagtggttcgctcagttcagtgacactaaggaaccttatagttacccggaactcaccatcttaggattccctttgttggctttacctttaacccttaaagacttatcaggcataaatgggacatggtatgggaacactttcaattgggtgactaactcttcccaggagaacactctgccccagcgccaaagaactttctcccaaagataagcttcacaccctcaggcttggaaaagttgatggagtaatagcaaatgcctccctctgctttaaaagtagtggggaagaaccatacttgggagtaacatcacacttgtaattgctgatagttcaaagatttgaggagagtgcaacaagggtgatatacaaggatagaagccctagtggggggctttcagaaactagtctccttctggttggaagtaccgatgggagtggcatgctctaagtaaccaacttgactataatgtaaaaaataacacatgggtctttccaaactcccccccacccatggaattccagacccttgtatgatgtttgctaacagtggcggcttactgatctgagggcgaactgaagacatctggactgacaccccttgccacaagaatcatctgagatattggccagggcatattacgtctctaatttttcaaaactccatttgtcaggtggacccttttcacttggcatgtcaaattccaaatgacatcgtaaatgactaccctaaatatggttatctttatcccaaggatgcctctattatatgtaaagaaaggaaagttctaagatatgagaaaaatctgccagtgtctctcacaagccacaacttagaaccatcccttcaaggaacagggctacattttctttgtggctcctggatacacttaatcctcccaaggcattagaagggaacttgtactatagctgcagtagttctcaacttattaaattctaccaagatgacagcatcatctggggacatccctaacttagcctcttttctagaaactgcactattctgaatacatcggacaaagggatctatcatttctatgccctcatatggagatttaactgaaagggcagcctggggagggcatgcacatgacaatctcatcttagaaaaagcatggatgggaaattctatagccagaggtatattctggtttatgggcatcccctctccttgaaagatcaatacttaatatctctattataatgcaatgaggatggaaggcaactgtatgggccatagaggcacaaccacaatctatagactctttagccttagtaggtagtagcacaaaatcgacaggccttagatgtccttacagctgaagtgggaggtacctgtgcacttttaaatgcaacatgctgcttctggattaaccctctagtagattaaggaaaatctacaggtacttaaagatcaaatcaaaattattgacaggctaagagaaaatgaaggcttcagccccaggtgactacaatccctctttaatgaattccagtcttctttatggaattggttagcccctttattaagctccctcttgcttacatgtcttacattaactcaatactataactcaatactatataacttgtataactcagtactataactagaattgtttcctatcgcctagaagcaatcaaattccaagtggtgttgcaaaccaaaccacacatggacatgccattcttccgaggatccttggatctaccccaggaggagccctagctgctgttccccattcaatgctccttttcagcaggaagtagccggaaagagtcatcacccaaaaccccctaacagcagttagggtgacatctcctccgggtagaatgttataggagttattaaaaaattatttggccactgccctcactgccgctgctgctgttgacctcgccagggctgcttcgtctccgaggtcagactgctcccaatgccatgaacggagacagcacctttgcaaagagacccagggatgatgctcagatatcagagaagaaacacaaggccttcaatgatattgccagatacttatctaataaagagtggggaaagctgaaaaactcagagaaaatcacctatgtgtatatgaagagaaactatgagaccatgactaaactaggtctctaggccaccctcccaactttcatgtacaataaatgggctgcagaattccaggggaatgattctgatatagactaaaactgcaggaatcaggatgaatatcctcagatggctttcggcatgctacaagggaactttccaaagatgatgcccaagaagccagcagaggaaggaaatgatttgaagggagtgccagaaacatctggctcacaaaacaatgggaaacagctgtgtcccctgggaaaagaaagtacctctgagaagactaacaagacatctagacccaagaaaagggggaacacgtctggacccacggactgcgagagagaaagtatctagtgatttatgaagagatcagaaaccctgaggaagatgacaaataactcccctcagggataggatgcaagcccatgatgagaagcagaaactggtgaccttctatgaacatgggcatggctgcgaacccctcatcatcaggtgtatagcaagtgaaagcaggagttcacgacagtgaaaagttgagcgtcatttttcttacagtgtgccaagagttagatattagcattttcattgtattttcttacagtgtgccatcctgttagatatttgcatttttgttgatgaatgagacatagttaatgcatatttctgtttgtgtatccatgcacctacctcagaaaacaagtattgtcaggtattctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataaacatttacaaacttaaaaaaacagataggacaaggggtccttggcaaggtttttttcttttaaagcagctccagaaactttattgcctagcagaaaaacagcttgaggggctgagccggcaagctttgatatgcaaataccagccatcagaaactgggtccactcaatacagcgattcctgcctcaacttcttgtcaccacaagtgcctagcatcatggacaccaccacatatccccatgtgtatagaacatcatagccccctgcatttgcatactcaaaggctagggtgggaggaccctttttttggcgggttaagtgaatgatatacctggtcaaaccaatcccctgggcctcaaatcagacactgcctcctccagcctcctaatataactggctcttttccacactcggagttccccctctcagcttggagcccccctccatctctgtacaggagagcctcttccttctttcttgcttattattatttgtgtatccatgcacctaccccagaaaacaagtattgtcaggtattctgtgcatagaacatcactaccctcctctctccccagatgtgactactgaggccagttctgggtgtttcttggtattaaactctctctgctccttaaaagcactccacatgtgtccgtgtcgttttatttaaaccggcgagacaaaggaccctggtgttcctccggtcatcggagccatatcacctacattcacgattgtgtgacaagagcccttccaggtccatgggttcttcacacatctctaaaatcaattcagttcagttcagctgggtaagggtccagcaatcacactctctctaccaggctgagaagcaaaatgatggcaaaaatgaatgaatgaatgatatatactgaaggtaaaactgaggtccataaagatacaaaaatatgcctccaacaattttaatttctgcaaacttactagagctgaggcaggagaacagggtctggaggcagggaacctaaggccaattcacgctgacttcctagaactaaattaagatgaaaaccccaacttttcacacccaagtaacaaaagtaccagaggctactactccctttgcaaaggccccctcccaccctgccttttctgtgtggcagatgaaaaactgaacgtacctctgattggtcccctcctgcaaccaatcaggctggtcatgggccaagtcttcatttgcatagaagtgtaattttgtaacttcacttcagcctctgacaggtcactttccacaaccaatcagacgtctgcatagggtgtaactttgtaacttcacttcagcctctgattggtcactttctgcaaccaatcagactgatcatgggacactacttcatttacatagggtgtacacgaagtaacaaaatgggaaacctctagagggtatttaaaccccagagaattctgtaaccagattcttgagctgcttgcttgagcccactcccaccctgttgagtgtgctttcattttcaataaatctatgcttttattgcttcattctttccttgctttgtgtattttgtccaattctttgttcaaagcaccaagaacctggacaccctccaccggtaacagagctataatgacattatacatcatgtttaagaatttatgattcaaatatttaattttcagcaataacataaattaacgagaatttagagataaggaacaaagttacttgatttacaaaagaatgtaaatcaaattgttttgaatactgccttgaaattacgatttcacaagcaaaaaagttctttgtataacctctgacctgctaccatctataaataaagaactaaagtacaaagaggttaaattacttgaccaagaacagagctcaaaataaaatcctagtatcctgtttctcaatctagtgttacctatattatcctacactatatctctcagggcttttctccctttggattctgccttccaaatacagacatctagcaccaatggttaaagaacagggcttggggctaaacaaacagactaagagaaactcgtctccaccacttgaaaagctatataaccctgaatacattaacatcctctaggtctttttttttttttttttttgatcagtaaaaaggagataattgtattttacctcaaaaggactccataataaaagaattttaaaataagttatatataatgtgtaacatattgcaaaattttatgagagatattttctgttaattttaaggctaattgaccaaataattcactgtcatatctggaagtgatgttatttgaatatccattatcagagtcctgaaagtttcaaagttgcaaaaacatagtattattcaccaatgaattgactgttaataaaaagcagaacaggctagaaaatggttgaaatatcacctaccttatatataaaatgggtttataattgtaccacattaaattttttaattaaatgaaaaatttatgcaaacctcttatcatgatcatgatgccctgtaaataaatagtaaatgctcaataaatgttggtatcattattaccaaaaggttaaaaaggagttctctatttgcttaaaaatagtaccaagggtatacgtggatgagcagaagtaatggctgaaataagattgtcatgtattataattgtataaatttggtgtgtacaaatataggttaccacttttgccttctttctactttggtgtatgtttgaaattttatggaaaaaaaagaaaaagatagtgagaacaagaagatattttacattaagatgagttgttttaaagaaaccattcagcaaagtaaactaatgaacaaatgaaacctaatcattgtaataaaatacataagcaaggaaaagagacagagcccctgggaagttttcatattgtccttcaaaattagtagttgcctacagctgggaaaatagagggtttgaaggataatggctaaaggggatataatttctttttggtgtaataaaaatgttctaaaattgacagtggtaatagatgtatgactctgtgaatatactaaaagtcattgaattgtacacttcaaacgggtgtatggtataagtccattactgtactgctataaatacctgaaaaagaatttaaaaaaaaaaaaagaaaagaaaagaaatatcgagcctgaggtttttataaaagaaagaggtttgattggaaggcaaagcaggagtaggtgtcttacatggcaggaggaagagagagaggagagaggtgctacacacttttaaacaacctgatcttgtgagaagtctatcacgagaaccgcactagggggatgatgctaaaccattcacgagaaactgcctccatgatgcaatcacctcccaccaggccctaccaacattggggaatacaatttgacatgagattggtggggggaggggcagcgcatcgcaataatgctgtttaaaaaaaaaaaaaaaagtatggtcttgatttcccaaatatctccgaaatcatctagttgtctttttcctgtctctttttatgaacaagtcaccaccagcttctacttcaacagcaagtggtctcctaccttccagttttgttttctgggatgtgatccatcctcaacacatcatccacaatgttcttttacttcccagcctttgaccaagctactctctcagcctagactactctcctcccaaaccccttttaccttgctggttcctactcacctttttgggcctcaacctaaacaacatttctgccaggagtcttttccctaatcccctggacttctgtatgtccctctgttgtctatccctaccaccctgtgtacttcgcctatcgtaacgctcctaactatttactgtcttctcctctagacttcatatatacaatgattaggggaaatgtctaattcatacccccagcacagtgcttaacatgcaacagacattcaattaatattggctaaacaaataaataatccaacaagtccttatctttataaggcttttgtttttacacaaaatgaagatagtgtaccaaatgataacttgtttcttcctttctgatatatatccacaggatgacctcaaaatttatagtattcaagagccctacgatttctcagtaaaaacaaccaactaatgaagatatgattaaattgaagttcatttttatcagcccctatttaaaataaaataggttaattagataagaaaattatctctaatacaaattagctgttgggaataatcaaaagaaaaaacttaacactatctgtacctttttaaaataaaatacataagtacacttaaaaatcagcccaaaacagacattaaaaactatatttaagaactcgccgggcacggtggctcacgcctgtaatcccagcactttgggaggccgaggctggtggatcacgaggtcaggagatcgagaccatggtgaaaccccatctctactaaaaatacaaaaaattagccgggtgtggtggcaggcgcctgtagtcccagctactcggtaggctgaggcaggagaatggcgtgaacccgggaggcggagcttgcagtgagccgagatcccgccactacactccagccagggcgacacagcgagattgtctcaaaaaaaaaaaaacaaacaaaacaaaacaaaaaaaaaaaacctcaaatttttgaaaaagataaatgaattgcctgagagcctgcctatcaggagccacatgatacaggagagaaagactgtcctgaggaaggttacgagccaagcctaagcaaaaagtaagtttcttttttttgcctcaaggtcctatactcccagtttcctcttacaatccctctgtcactcaactctggtcccacagcaagattatgctatgtacaacaagtgctgcatacttcaaaaacaacttcctcaaactaatatctgtggcaacagtagctatttaatggcctccaggtctcagcaaagaaatcctaggaaaacactggggatcagctatgtaccttatgttacaatttggtagcctggtagacacatctatcctcattgtcgtagatctatttccttccaacctggaatttgaaactccatgaacaaattacaacagctaaaaagtggtgctgctaatgttagtgtctcaatttagcattatttgaaatctcaaaataccctggctaaacgaaaattcctcaatggtaagtctagaataattttctgtactagaatcccttcgctgctgagattctcatgtaatcctctcctccatgtttatctccctgcaattctgccattcttggaacacagtaagtattcaataaatatatataagtgaataaatgaatgaaccttctaaaagctccaggttaaaaaggaagaggcaaccaccacctcaaatatctcctaaaagtaactaacagtgtcgtacatataatgcatgaagtataataagtgtgtaaattataaggtatatttgtcaactcccatgtagcatgtaaattgtgtcattatttaatatgtacactgaggtttttacaataatcagtcttttaagaatttaagtgcattcacacatttcacctaaaaattatcacaacaaaccaaattaatgcagcacttcatgccacagtctcaccaatcaagaagaaatgcttactccaagccaaatagtaatagtaataaagttgaaggcagctaactaaaatatgttgtagatacaatctaaaagtaaaattatatttgataatacacaaatttcatgtacattatttagaaattaatataattatgtgacatggtaattctcagctgggtgttgtaataaaaggagataaacacattttaggttattctaaaatgtttggaatttagctagcatagatttgtttaattttataaatgagaaaaaaatgaacatcttatagacctgtggttaatggatgaccccaaaaaattatataatcaaagaccaaaggataaaaaacatatctgcttgacacggatatgacataatctgatatatggcatgttttaaagttgctattatattataaatatcaacctattccttatgttctgatgcaggttattcccaatattcagtaatcttccacagtggttattttcctgagtgctttacaataaacagataagccatgaggcaaacccaacaatgaaaaacaatgtttatcaactacaagactcaggacttggtaagcacacttaccaaagaacagataaggtaaagaacaaatagctcccataaattaaaaatcatgaaaacttcagaaagacatgaattaaggaaggaaagcacacactaattggaaccaagcgttacatcaacacacatagcaggctttccttctaaatagtctttattatgcctgctaaaactacttatattcaggtaatatcttaatacaactgatttttttaaaaaaaaaacaagagtacctttccaggcaataataaatgcaaccagtatcattcattaccagcaccaatcactcaaaccacaattctaattcattttccacagaagtctcgatttcctgttatttattgtaagtcttccagcagtcttactattccttcttatttttatccaccattccttatgcctctttcctagaactatttgccctttgatatggtttggctgtgtccccacccaaatctcatcttgaattgtagttcccataatccccacatgtcgtgggagggacccagtgggaggtaatttcatcatgggggcggctgccccatgctgttctcatgatagcgagagagttctcatgagatctgatggcttcataaggaaatttttttccccctttgctcgaaacttctctctcctgacaccctgttaagaggtgctttcccccatgattctaagtttcctaaggcctccccagccatgtggaactctgagtccatttaacctcttttctttataaattacccagtcccaggcatttcttcatagcagcatgagaacagagtaatacacccttgatcttgaaactctgacactgctttatctatgtagaatagcttctaaataacagtacctactaatcatgccttaaactcaggattcttttccattagaatattctgtattctgactatataacataccagtgcaatcactcactgtttcatacattaataaaaaattgttggggaaaaagagtcaaagttcagcttggaggtaattgcaagaactaatgaaagtaacaaaaattttaacatatttacatcaacccaattcaaggaaaaagtgaaaatcatactctcccatctctgaaagattatagaaacttatatttaacatttgatgaattactcagtgagaaaaacaaggatatttgctactgctaactaaattagttttaaattaattcaaagaataaaaagaaaagacagttttctaaatagcaatagaaaaggtgagtataaaacaatgcacaacaggatcaaagggtttctggagacttatgaaaaagataacgactatagtcatctattcagtggtgtttttcagttcttcagctagccattgtcatgaaaaaggcagcataccagtctggataccgtgtggggcctagtctgagaacaggagagagttattttttaagctctcctcagccaaactgaggaaggctagttcctgactggacccaggttaataccgtaatactctattgaggttgaagtcagtgactataagaagattattgagttttgaagccaaagcttcaaaaaataaaagagtttgtctgtgaatctcaagtaaatttttgagaagtcatgacacaggaacacagttttaaaaagagtatgatttgcttacagcagctttacaataacactaagaaaatctcagagcatctgttcttcaacttctcaatcctcattccccacatcattcttccctcaaaaagttaattttaatgtttattaatgagaccaaacagctagaacacatttttaaaaagatctccacgcacttctgatttattctcaactcaactttgttcaattactgtccagcacttttttaatgattttctgtttaaccacgtagtgtgtatagagggtgctgtgggttgaattatgtcctccataaaaatacattaaaattttaacccctagaagctgtgaatgtgaccttatttggaaatagggtctttgcagatgtaatccgaggtaaaatgaggtcatgctggttcagggtgagccctaagtccacttactggtatccctatatggagagagaaaagatatgaagacagaaagctcagggaagaaggacatgtgaaggtgacaaagactggagttatggtgccacaagccaatgaataatatactaaggactgccagtaagcacccgaagctagaaaaggcaaggaagaattcttccctagacccttcagagggagcatggccctgccaacaccttcattttgaaccttatagtctccaaaactgtgagaaaaaatatttttgttgtttaagtcctctagtttgtggtaatttgttatagcagccctaggaaactaatacaggggagtagaggttaacagttctgaacctgctttatacacatatactggggactgagcaaacaagtaaatggatggtagatggtgggaggcttctaactgttggagagggaagttatagataagcaagggagaagggctaaaataaatcctgctgtctggattagagtcaaagacatcataaggaactcatgtttggctcaatactaatactgacgaataaacagataaataattctagatatatgtgtaattataggctaatatacatacctgcataacctagccctgtcctctgaaagggcctaaaagcaatgacaacccaataataacaagtatgtccagcacccagatcttggtttctgaataccactctccaataaaaagaaccagagctcattggtgaaatgattgattcaagggctaaggtaggactaagatgaacatggagcattttgtggtacccaaaagtaaggaagtgctcaaaaaacaaaaggatggcagggtggtgtccatgtcaaagtgtcaccagaacaaccctgaaagagttctcaatggcaaaatttgaacaacaaaatattattactaagtcataatcaaaaatataaaacaaattcacatagtctatactggcataaataaatgattgaataaataaataaatgagagagaagaggttactttcttacagaagaattccaaatcatatatataagtatttagtcctccaggatgtagaacttagtgcctctaactcctattttcagtgtgggcaggactcagtgacttgcttccaaaaaatagagtatgattttaaaaaataatagaaatggtaaaatactgttttatagaagagaaacctggcaaacatatcttaaacaagcgaccaaggtaaatatcactaatgatgtcgaattattattatgtacccctgatatgatatgatgaaaagaatattttcatatctgtagtattcttgccaaaaacttacaaccacagtctaatcatgagaaaaacgtaagacaaatctaatttgaaagacatctataaaatatttgactagttctcctcaaaactgttaaggttatgaaaaataggaagagaatgagaaaccgtcacagaccagaggagattaagaaaacattacaattaaatgtaatgtggtgtcctggataggaaccaggaacagaaaaggacattcatagaaaaactggtaaaattctaataaagtctatggttaaaaaataaatgtgtacatataggagtccacattgatataaataaacaattaaataaatggaagagaagtggaagtggcaaatatgtcttaaagaagaattccaaataataaattcacatattctccctcacaggagatggagttaaaccctccgttcttgacttgcctccaaagaacagaatatggaaagaagaaaatttgttactatacaatgcagagaacttgcaaacctagtactgcctgtccctgagccttcctgggggtgtgtgtgtgtgtgtgtgtgtgtgtgtgtgtgtgtgtgtgtgtgtgtgtgtgtgtgtgtgtgtgtgtgtaacgccatggagcaatctcagctcactgcaacctccgccttccaggttcaagcaattctcctgtctcagcccctctgctgtaggtgggactcaggcacttgccaccaggcccagctaatttttgtattttcagtagagacggggtttcaccatattggtcaggctggtctccaactcctgacctcaggtgatccacccaccttggcctcccaaagtgctgggattacacatgtgagccaccacacccagccctggggtttttttaatgatataaattaccagtcaagctaccaacctggtccttaatttctctggtgctggctgaaaattcagccccttggggtctgctaacaaactttcttacatattgatctgacaccatttctagaattttgtcattttctccctgccttcagagggttgtcttttttaaaaaaaaaaaaaatcttgagttttagtgggatgccataaaggaataaaattgaggcgtgtgttcaatttgccatcttaccctagaaatttgcttgaatttctttctaggttggtacatatatagctatctaattagttttaactggatataccgtggaataaccatttctccattggtaagcatataaagttgtttcttatttttcactaaacgatgttgcagtgaatattcttatacatattatctttgttcatctgtgtgcctgtgctgagttaagaacatatacactttatgtaagttattcatggttaagctatttagcctcttagtctcactttcctcatttgtgaaatgcagagaacagtgcctacctcatatggttattgtgaagatcaaatgagttaacatgtgtaaagtgcctaaaacatagtaacagctatataggttgttagttattgtcaaattgccctctgtaaaggctatcagttattacagagccgcatttcccacctttgctcaaaccctggttattacagtctactttttgagaaggaagggcaattttattggtaaagacagcatcagcacctcattgtctaaactgtcgcttcactgtgactgagtttgataatcttctttccaatgtttatcgatcaatttcccttttccccatgcttatgtatatcttttacttataaattatgaaatatttgaaatgatatacatgaatatctgttttggggtatcatccttatttatttgagctttttcttcccaaagtgaaagcaagtttattaagaaagtaaaggaataaaacaatggctactccacagacagtgtagtcctatgggctgctggttgcccatttttatggttaatttttgatgatatgctaaacagggggtggattattcatgcctcccccttttagaccatatagggtaacttcctgacgttgccatagcatttgtaaactgtcatgacgctggtgggagtgtcgcagtgaggacaaccagaggtaaatctcgtcgccattttggttttggtaggttttggccagctcctttactgcaacatgttttatcagcaaggtctttatgacctgtagtttgtactgacctcctatctcatcctgtgatgtagagtgccttaaccgtctgggaatgcagcccagtaggtttcagcctcattttacccagctcctgtttaagatggagttgctcaggttcacacgcctctaacatttcccccctcccttttataagagaacccttaatcctaatgattgcagagggatgaagatccatcttcttctgtaacttcttcaggctgaataggggcaatgatattcctgcctaagtatgagggtctcttgcactcagggtagagaggagctcagtcagaaagcaccagtatggtaaggtccattcataactctttaagtttcaacagaaggtaaatgtttaatttatgaaaatattcagtaagcttctcctatattcctacacaaagagtgtaacagcaatatattccacaagagtacagcaaaataagtaaagttattccaagtaaactaaactagaaggttttccatgaactggacaactgttgaaaccaagttgatatggggttgctagctgattgcaatgtgcccagaattagaatactgattcagatttttacattacccatcccacttgttctgagcaacagtcagagatcacctggttggttcacaggaattagttcacagggttagcctacgttgcagaaacaaacttaaaaacaattaatgagactagaatttaacaacaagtgtaccatagtttttgaaacatagtatttccctctccagtttctcatttttactaaagacaaattatggtaagaccgatatgctttataaaacttggcctgattatttgcataaagtgcagcaagaataattatttttgacataagctcttttttaaattggctttgatggaactctgttccatagatggaatttcagataagactttttttttttttggagatatagtctcgcacggtcacccaggctggagtgcaatggcacaatctcagctcactgcaacctccacctcccacgttcaaacgattctcctacctcaaccttctgagtagctgggattacaggtaccaaccaccaagtccaactaattttttgtatttttagtagagatagggtttcaccatgttggccaggctggtctcgaactcctgacctcatgatccacccaccttggcctcccaaagtgctgagattacaggtgtgagccaccacgccaggccccagataagactttttaaaagccaagcccagccttgggtttctaccctcaagtagctatgaattgggtaaattcctctcctcttggggtcccaagataacttggagctcctggacctgatatgaaagtgacactctttacttaccacaggtcagaaatcctgtttacagggactgtgtaggcaaggaatgaggccatttcctcaagggactttaattggctctgtaagtcaagtttaatttcttaaaggaaaacacaccattccagtcaaagccttggtaaaataaccaatttacccaattgtgtcctgttacaaaagaaaacagattcttactgcacctatgcaaataaccatattgccataagttaagaatactcgcaactagtttccaaattctggagaaatcaggtagagagaaataaatatgctccaaagtttgttcataggagtacactcaactgttaaaagctgtaaaaagctcaaaagaagttttcttgactctgaaaaacaaaggatcagcaacattttaagcaaagttaaaaagactaggcttcttcagtttagtccatgtcgttatcttctgttggatagttatgaacattttagctctgagagttctgaaagttttttcctttattctgatgtcataatctccaaagctatcagaaaacttgcacttaagaatacctgctagagttctatagttgattataaatcgccttctaaagaggactaaaacaagacaacaattgtctgtggatagtaaaaagttttaggccagcccctattaaagccacagtagataaggaaatttggttgattttgtggtacacagaattttacataacaattataaataacatacattaagtcgtattagaattataggagtttcccataactttggaacatattccaataacacatttatgcaaatatagtacaatgcaaacaaaacaccattttacatttgataatgcttcctgtatgacttttacaccaaataagccaaatttcacctttatattaatgttctattaatgttaaacccaattcttaataaaattttacaaatatgtctatccaatcttaatcggtttgaccataaggtaagattcttataaccctttacatttttttgtgaaagagcagattagtgctctaagaaaaacctgttgtgcttttattccaatgtttaatttacggaaaaactgagtaacacccctttaactttagtcaatatgttcacacacagaatctctctcaatttttttcacaccatccacaactgttcaaacttttagctttattctaacttaaaataattatttaactctttaggcaaaaaaatccacattcccgtgccttcttataatcttttaccaaaagtacattttattttccttacacaccttgcatatagaactgtttcttcaatagtctcaattacatgttacgatgttaacttttacgtttggtgaaaaccctggttagtaagcaattttaattgtgttactaggacacaccaggcagaactgcagataagaactgactctccagcatagctagggggcatggctaactccacatgtccccaggccttatctagaatctaatggctttacggtaggcaaattgaacagtttccaaagtcaaccagtttgaccttaaagcatttagcaaatctaatatctgaccttaatttagaccaaatgtctacattttcaagacattttattttacctataatttttaaaactgtctttatttccaaaagattactaaagtcacgtgaacaaaaaggcattaaagtttccatttttctgaaaaaatattaagtgcttatttttctaagccaatcaattagagctcttttatacataaacatacaacacatattaatacatagaagattccgcacgtgtaagatttttcattgccagtttcttaagtggattactggcttcagggtggagcccttggaggaaaagcgccaggaaagcatgcgtttctggggccaaataagcagctgaaggcaaagacagatccccaaaattaagggtgccattttatgctggttcctggatccccaaaaggagggaaatactacagaagacagtacagtgcttctactctgcatttcactgcaaggcaacccaaagccaatcagcccatttcgtcatcagcccatccttcatggaagtctcatctcccagtggggggtggggatgtttccttatcttccaggtggccaagagcatacttctccgatccaagtgtgcaaagagtcaagtgcccctccctaactactattagccatcccttaaagtatatttcctacctagttattacacaccaaagctctctcataatgcaaagtaatttctgatacccccaaaactcaaaactgtcagataacacaatgcaaaacagaacacagcctttgattttgagagggatccatgtgcttttaattcctggggtttcatgaggaaaagagggttttttccctaaacagggtctgtggcacttcctctgtttttcccaaggggtcttaggctaccagaagttatcttagggcctctcatgtgtgcattaagagtggaaagacagctgggcaccatggctcgggcctgtaatcccagcactttgagaggccgaggcgggcagatcacgaggtcaggagatcgaggccatcctggctaacacagtgaaatcccgtctctaccaaaaatacaaaaaaaattagccgggcatggtggcacacacctgtagtcccagctacttgggaggctgaggcaggagaatcgcttgaacccgggaggcagaggttgcggtgagccaagatcgcgccactgcactccagcctgggcaacagagcaagactctgtctcaaaaaaaaaaaaaaaaaagtggaaagccaaaaaacaaatggagaaaaataatttagtcgactgaaaagaaaaaacctttttccataaaaacaagttccaagaagagaaaaaaataaaggcctgttaaatatatctatagcttgtctatccatttttacgtaagctgacttttaaccatagtgctctttaaaaaaacaaatcctttcagatctcttattacctgactttagccttcccaaatgaccaatatttctagcttctgaactttatcaaaggtgctgagagaaaggaaaatttaagacagtccacggaggagaagagaatagacaagatcacacagatattaaaccacagaaatgacttacttcctagtggagaactgaaccaggactgccagtgtgaaagtgcaaaatgtcagctactgagctacatacagtaaggggtagtccccatttcctttcccagaacaagtctacagtagttaattttgagcttgcagaggcttttaactatttaatatgatttttagagctaactatgacatgaaccctaaaattcctgttccctggaaaggggagaccaaaagtactgccacgtggttacaaggtcaagctcccaaggacgtaaaacaaggtggagacttcatccagtatttgtgtttgtttcagagacctgcagccaaatttgttactgaccagcttgctggttattcttgaaaagcgggcttacaggtgttctaagcccgtgttttatcctgaagtacccctcaacacagaaaaacaaattcatagcacaaaatacaccagcttaagactagccttagaattcttttttgcattaatcaaaactttacagaggagataaacactgatttttttttttaaccattcagtcaaccgtttgcacagagagagagagaagcctgaaatctgactggtaagaaattcttactcttttgccggcatgccaggcttctgggttccctttccctgagcagccctagtgatccagcttgtggcaccatagccatgggggccaagctgcatcataaaggaaaattttttttttcgttctggccagagcaaagtccatgtgataaaaacagagacattagccactctgcttagcacccaatatcaaactggcaaggcttaaatttgtccccagatgggccccatcatctttaatccaaactccgacttaagagtttcaacacgtggtctctgggcaagatggtcaccctgagtaatagaaaagataggaaaggaaaagtagagaaggaaagtattgcctgtggcagggtggggaaggtgaacagcttagggaggccagagaaagacccacccattgcagcaacactgaaaagttcaggcggctgtttctcagtaccaaagagatcttttccagccagtctcatcagctctcatttccccttttagggaagaaaaacctccccatgtcctacgatcctgtacatgcctaatcctgccacccacagccatagcaaagagtgcaaggcagattaatccaaagagaatagcagttaacatccaatagtgacgagaggggactctaatcctcctaagttgggcctctaacccaaggtcagtcaagcatccttgccttttattaagaggggctccaacccactgtgtcttaggagagactctaactcccctaagttgggcctctaacccaatcccatcctttacccaggtaccccactacttacccaaagttgtccaatcagtgctgcatctatttcctttgggtcgggggtctcaatattgtcccttttgtggttcatgagaaagatgttactagaccccaccacttacccaaagttagcctttgggtcaggggtttctgcagtatagtcccttctatggtcgccagaaatatgttacaggaacgaggtcctgatccagaccccaagagagggttcctgtatctcgtgcaagaaagaagtcagggcgagtccacagtgcaaaatgaaagcaagtttattaagaaagtaaaggaataaaaggatggctgctccacagcctacaggagctctttaggcactagagatactatttcctggtcaattatattacaaatatttgcttccagtatgtgtcttttttattttgcatcttttgtcaatgttcaatttctttaaatttttattaaatgttttgtgacttaagaacatttctgctgggcacggtggctcacacctgtgatcccagcactttaggaggccgaggcaggcggatcacgaggtcaggagatcgagaccatcctggctaacacggtgaaaccccatctctactaaaaatacaaaaaattagccaggcgtggtggcgtacgcctgaagtcccagctactcgggaggctgaggcaggagaatggcatgaacccgggaggcagaggttgcagtgagcggagatcgcaccactgcactccagcctgggcgacagagcaagattccatctcaaaaaaaaaaaagaacatttctgacctaagaatataaaattaatctcttatctcctagatttttatgatttttaaaagaaatcaaaagctctttattccatctcaaatctgaggtagggatctactaccacatttttcaggcctaatacttccctgctgctttaaaatgctgtctttatatcatgtattaaatttccatatacgcatgtgttttaaaaaagtacttaagttaatatgcttgctacagaaatgtgttatacatataaacatgtatgtatgtatatgggggtatttttgccaaatagtggaacagaaattctaggtttttgttttattctctgatttgtttggctcatataccataaattggcagggattttattaattatgtgtgttctttccaacacagaaaaaaggcccccatagaagccttctttactcttaaatgcccatggagatcaaacctaatcctaggcttatcttaatggctaaatctccttggagaataaactaattctaggagcttcaggtggtgtgaattagactatgtgaatcatttcaaaataaaaattattttttaaagaaatccaatatatagatgtttttaggaaaagaaagcaaatcataaaacatgtatgggatgatcagtttatttaaaagcctgtgtgtatgtgactaaatgaacagcaaaaggtctggaagaacatagaacacattaataacactggggacctcttgaaaagcaagaattaaagaaggaaacgaaataaagggagacttctttttttgctccatataatttttcaaaataattgtatgtggagtcaaatttttcaaatccatgaataatatctgaaatatgaatttgcttttaaaacaatattcatctttatgctcttgtaaatgtgtatttattacctttataaatcagaaaaaataagaagaaatacataatagtagttgacattaaggacaagtttgacaatctctttttaagttctttttctcttcattttctttttcacttacacctatatgacaacaggacttctggttcaagatcactgcctgagtatacagacatatattccctccctttcaagacccagtgaaatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtacaaaaccaggattgaaaaaaaaacgtaggtggaaacagaaaccttaactgacagtctacatatccattgtttcattcaacaaaattgaacacccaggacataccagttcctgtcctatgatacaaacaataggcaaacccaaaataaagcagggggcacaaaattgtgagggtggcagtagaaatatcacttcagataagtcaggaaacatttctagggaaaaaaattgagaagagagacgcaaaaaaaaataagggagcaaggaaggagaacaagaatcatttcttaagcaatgataatgatgtaaactgtgctaagatatttaaaaatcatcgtattaaatcatcaccacacatagagttacctccaatttagagatttttttaaaaaatgaggctcaaagaagtcagaaattattcaaggttgtacagataactataataagtaataccaggttttaaatgcagctcaagctcttcaccaaattaataatactaattttatcttctgggaacctacacccatgctaacaaaagccaagtggggtacctagacttctaaacttgccaggctgtaataaagcaccctaaaactgccaccatagtagtatccaagaagcccaagtagggagatagggcctttactcctgtccagcaatatggtgacacctcttcccctcttccccttaggtggtatcagaggaggcctggtagagactgaggactttcaccatcactgagtagtaacaaggcaacccacactgtggtgtcaatggtgataacctgggaatcctggacttccatccctacccagcagtaacaaggtgctcttccttatccctcaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttctcctgagtttcttaaattatgtttgacagttgttggaagtggttttaaatgtatgtagaggaaatatgtgaaactcttttatcataaatgagggacggtaaaggaatataaaaacaggtaagatttctctactccactcaaagtggtaaaaaaaatcagtaaactgtgatacatatgtatatataatataccaagagcaatgtatataaaaatacctaaagcaactactagaagaactatacaaagagagacactgaaaaacacagatgaatccaaatggaattctaaaaatgttcaagtaacccataggaaggcagataatgaaaacagaaatggagaacaaatacaaagacttaagtattaacatataaataattacattaaatgtaaatggtctaaatataccaattaaaagatagaaattggcacagcagattgatgagaaaccacgtcccaactatgccgttacaagtcatttacctcaaataataacatagataggttgtatgtaaaaggatataaaacatatgccatgtgaacattaatgaaaaaagcgtgttagctatattaacatcagataaagtaagctttggagaaaataaaattaccaaagacagagagggacattatataatgataaaagggccgacagaccaagaagtaatagcaattctaaatgtctacacaccaaacaatgtggctgcaatatataaagcaaaaacacagaaataaaaaaatacacaaatctataattatatttgtagactttcaaacactcctctttcaacaactgatagaaaaactagacagaaaatcatcaagtatacagaactcaacataaacaagatctaatcaacatttataggacactcccccactacaacagcagaatacacattctttccaagtacccacagaacatacatcaaatataccatacggtgggccctaaaacaaatgtcaacaaatttaaaggactgaaatcacatgaagagtttctggctacaatggaaaaaactagaaattaataacagaaagacagcaggaaaatctccaaacactttgaaactaaacaacacacttacagtcctgagaagcaaagaggaagtcataaggcaaataaaaaaaaaaaccacactgaactaaaatgaaaatataaaatatcaaaatttgtgggacacagctaaagcagttctgagaggaaaatttataatagcatattttaaaagtggcaaacggccaggtgcggtggctcacacctataatcccggcactttgtgaggccgaggcgggtggatcatgaggtcaggagatccagatcctggctaacatagtgaaaccctgtctctactaaaaatacaaaaaaaaaaaaaattagccaggcatggtgacgggtgcctgtagtcccagctactggggaggctgaggcaggagaatggtgtgaaccaggaggcggagctggcagtgagccgagactgcaccactgcactctagcctgggcgacagagtgagactctgtctcaaaaaaaaaaaaaagcgggggggggggggggggactctcaaatcagtaatctaatctgctaacaagaacctagaaaaaaagaagagttcaacagacccaaagcagaaaaaaaggaagcaacaaagagcagaaattgctgaaattgaaaacagaaaacaaatgagaaaattaatgtgatcaggagatggttctttgtagagatcagtaaaatcaacaaactgctaccaaaactgaaaaacaaggcaggaagacacaaattaacaataactgaaatgaggccaggtgtggtggctcacacctgtaatcccagcactttgggaggtcgaggcgggcggatcgcctgaagtcaggagtttgagaccagcctgaccaacatggagaaatcccctctactaaaaatacaaaaattagccaggagtggtgggcctgtaatcccagctactcaggaggctgaggcaagagaatcgcttaacccggcgggcagaggttgcagtgagccgagatcgcgccactgtactccagcctgggcaacaagagcaaaactccgtctcgaaaaaaagaaagaaaaacaataactgaaatgaaacaggagacatcaccacatagcctgcagacatctaacaaataataagagaatgttataaacaattctacacacataaacttgataatttaggtgaaatcaaccacttcctctaaaaaacaaatgcaacgcatccaatttgaaacagataatttgaattactttataactattaaggaaatcgaattcataattttaaaatttcaaaaattaaaaatctctgggcccactggccaggtgcagtggctcacgcctgtaatcctagtactttgtggggccaaggcgggtggatcacctgaggtcaggagttcaagaccagcctggtcaacatggcaaaatcctctctctactaaaactacaaagattagcccggcgtggtggcacacacctataatcccagctactcgggaggctgaggaaggagaatcgcttgaacccaggagttggaggttgtggtgacccgagatcgcaccactgcactccagcctgggcaacaagagcaaatctgtgtctcaaaaaaaaaaaaaaaattctgggcccagagtgtttcactgaaaattctaccaaatgtataaaaaagaatcagcaccattctatacaatctcttccaaaaaataagagagaacatttccccattcatttataaaggtattatagtattaaccctgatatccagagagtacctgagaaaaaaactacaggacaatattccttatcgatacacgaaaacaatccttaacaaactataaacaaaattcagcaatatataaaaagaattatataccatgaccaagtggcgcttattccagggataaaaagttcgttaaacattttttaaatcaagtaataaaatgcaccaccatatcaacaaactaaagaagaaaatcataaatcaattcattgaggaaaaaaaattgacaacatctaatacctattcatgataaaaaccctctgcaaactaggaataagaagtgccctcaaattgataaatggtatctacaaaaacctacagctaacagctatactactgctacttaatagtgaaaagactgaatgctatatctgtgtaatcagaaacaaggcaaggatatccacttctactactcataaacattgtgctagattcttctagtcactgcagtaagtcaagagaagaaaacaaaaggcacacaaatcagaaagaaaaaactccttatttatagacaatgtgattgtctacattcaaaattccaaggtatctaccaaaacaaactcttagaactaatgcgtgagttcagcaaggtaacaaatacaagataaatatacaaaaagcaaatgtggccgggcgcagtggctcacacctgtaatcccagcactttgggaggctgaggcaggtggatcacctgaggtcaggagttcaaggacagcctgaccaacatggagaaaccccgtctctattgaaaataaaaaaattagctggtggtggcacatgcctgtaatcccagctactcgggaggctgaggcaggagaattgcttggaccccggaggtggaggttgcagtgagccaagatcgtgccattgcactccagcctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaatattaagtgtaaatctaacaacatatgcatagaaaatattaaaaactatacaacgctgatgagcaaaataaaaaatctaaataaatgaagaacataccatgttcatagactggaaaactcaccaagaaaagatgttatttctccccaatctgatagctaaacaacaaaattcctatcaaattcctaggaagactttttttgtattcttttttgtgcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccctggacaccagggctcagctgagcttacccagttttcaatattccacatgttctcatacatcactgctagaagaaacaaactgtgcacatgacttcgcagtgatagaacgactataaatttgggtctggtgtctcctggaccctgtcctttgcttctttttccatcactgatttaaatctgtatcctttagctgtaacaaaccatagccgtaagtataacaactttaagttctgtgattctttatgagaatcactgagtctaggagaagccttggggactcctaaacacacatatataaaaaattaactcaaaatggatcacaaatataataataaaatatttaagaaaaaaatgagaaaatatcttcaagatgtagaaccaggcaaagagttcttaaacttgacataaaaagcacaaaccataaagggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtctttaaaaaaaaaaaaaaaaaagtccaggtgcagtggctcatgcctgtaatcccagcactttgggaggctgaggcaggtggatcacaaggtcaggagttcgagaccagcctggccaacatggtgaaacgctgtctctagtaaaaatacaaaaattagccaggcgtggtggcgtgcacctgtaatcccagctactcaggaggctgaggcaggagaatcacttgaacccgggaggcggagcttgcagtgaaccatgatagtgccactgcactccagcctgggcaagagagcgagactctgtgtcaaaaaaaaaaaaaggctgaggtaggaggggatcacttgagcccaggagttcaagaccagcctgggcaatgtagcaagctccagtctctaaaaaataaaaataaaaaaaattttaaaaatagtaaaaccttgcgctttgcaggagatacaattaaaagtgagaggtgatgccagctgggcttcctgggtcgagtaggggcttggaaagctgtaaaactcactcatttcctgcatcagggattacttcggttctggataaataatattgaggtataatatatgcttaaaatattcctaacaccaggatttacttatatgttttcttccccaagaaagctataaacagcgagaattttaggtgtaagttttcctgtgtgccctcccccgaaaccagagttaaagaaaagattaactgcccatttttctgtgatcagtgggccttatctatcctcccaattccttgtaaacactgtttgtaagttctataagatcctgcttttttgctgtgcagctgcaaggccataaatcaggtaagcgtaagtcgcaatttcagtttttctcaaaatctaaagcatgtcacaaaataatttactgcctttgtttctcgctcctgtactggaacatacttcccgcctcacatatctcccgccttaaagagtttaaaaggcaatcacccgagctagcagtggcaacccattcgggaccccttccatgctgtggaagctttgtactttcgctctgctcaataaaacctacagctcattctctctcttggtccaagtatctgtcactcgccatggtcagccgccacaccaattctttggcgtggctaggcaaagaaccttgggtgttacatcttagtgagccagccaggagactccaggaagagcatcccaactgccacgcagtgagtaccctcggacctcttttgcttgctattctgtcccatccttccttagaattcggaggctaaacactgggcacctgtcagccagttaaaggcgattagcaagaccactggactaaaaacacgagtgtcagcctgggaaagggctctctgacaatccctgaccctttggagttgggagcactggtttgcccggaaccagttttaagtctttcactttctgtagtggtcccgaagtacacccgggagtgctcagcaaatgtcatggtctcccagatatccaggttgagaccatggccccaccagaggctcccacagcatgggttactaagcgtgagacagccacatcttctgactcctgcgtcctgggttcaaataactgccggttagatttctttcctcacctggtaagcaagattattcccactagacaggaccaagaatccctatttaggagacttaagtttttaaggtggtgttcagaagttccttgttgatggtgccctctggaatttaggcaggtgttgccatctgatggccactttgaaaggccagttccccaccatcgtgtatggtctcccacatcaggacaatttgaagacagatctgtaattttcatgtggatggtagaggccctaggacattttcttcattgttccccagatgaatttcctttttttggtgcctctcaagtataatctgtggtgtatgggtacggcccttagagcagttgaattgctttttcaaccattcaatcatggatattggaagaaagaaaatatagtcaattgagacacgggatactggtaccaccttaagatgggggcttactcctttgatggaaagtggggacaaaaggctagagtgcagcagttgttctctcagccctggcctagaggacatcaaccatcccctttgagcttactaagcctcctgtcactaattcagagattcctccttgaagggcagttttatggccaggcccacgtaaattgggccttgacatgcaagcatcagtggtgcccccgacccaggccttgccaccccagaacagataggacgcgttggcaaagggaccacaataaatccaacagtcctcatgccccatctagtggtcaatgggtgcacggcagagggcaaggatgatttccattctgccggtaagcgtggttaaatctggtaaatggaaggctcaaggacgatcatgcgctccgagcacaattggactggacccttgggggatgccctaaggggaagatgagtccctaagactaaccaggggtgcgggcatacctgtgtttaaaattccagttgggcaccacgccttcaaaactggacactcccttgagatgtatcctgaataactgggacaagttcgaccctgagaccttaaaaaagaagcgactgattgtcttctgtaccaatgcctggccacagtactccttacaaaatggagaaacttggccccctgagggaagtattaattataacaccattctacaactagatcttttctgtaaacgggaaggtaaatggagtgaaatcccttatgtacaggctttctttgcccttcgtgacaatactgctctatgccaagcctgcaagatttgcccaaatgacaaaaacccacaattgcctccatactcagggcctccttccttagccccactctcttccctcactgactctcctccatccagccccaccaaagtgttagaggcacaccgaaaagaaaacgtaaactccgcgaaccaggcgcccaaactaagtcccttacaagcagtaggaggagaatttaggcccacccatgtgcatgtctctttctcactctcagatttaaaacaaataaaggcagatacagggaaattctcggatgatcccaataactatatagatgtcttacaagggttaggacagtcctttgatctagcatggaggggcatcatgttgctccttgatcagaccttaagtcctactgaaaaggagggagctttagcggcagcccagcaatttagggatttatggtatctcagccaggtaaacagatcaaatggccccagaggagaaggaaaaattcccccacagggcaacaggaggtcaccgctgtagaccctcattgggatactgactcagatcatgaagattggagccgcaggcatttgctaacttgtatcttggaagggttaagaagaagtaggaagaagcctatgaactactcaatgctatccacaattacacagggaaaagaagaaaacccctcagcttttctagaaagggtatgggaggctctaagaaagtatacctccctaactccggattccctggaaggccaacttattctaaaggataaatttatcacccaatcagcggccaatattaggagaaaactccaaaagtctgccttaggcccagaacaaaatttggaggcattattaaacctggtgaccttggtgttctataaaatggaccgagaggaacaggccaaaagggaaaagcaagataagagaaagaccgcagccttggtcatggctctcagacaagcaaacattggaggttcagaaaggacaaaaaatggagcaggacaatcacctggtagggcttgtgatcactgtggtttgcaaagacactttaaaaaagattgtccaacaaaaaacaaactgcccccttgcccacgtccaatatgccaaggaaaccattggaaggcatgctgccccagatgatgaaggctctctgggccagaagcccccagccagatgattcagcaagaggactgagggtgcctggggcaagcgccagctcatatcaccctcacagagccccgggtaagctcaaccattaagaaccaggaaatcgatttcctcctggacaccagcacggtcttctcagtgttaatctcctgccctagacagttatcctcaagatccattaccatccaaggaatcctaggacagcctgtaaccaggtatttctcccacctcctcagctgcaactgggagaccttgctcttttcacgtctttcttatcatgcctgaaagtcccacacccttattaaggagggacatattatccaaagctggagctattaactacacgaatacgggggacaaattacccatttgttgtcccttacttgaggagggaatcgaccctgaagtctgggcaatggaaggacaattcggtagggcaaaaaatgcctgtccagttcaaattaggctaaaagaccccaccacttttccttatcaaaggcaatatcccctatggcctgaagctcataaaggaccagaggatattattaggcatttaaaagctcaaggcttagtgagaaaatgggacagtccctgcaacaccccaatcctacgagtacaaaaaccaaatggtcagtggagaccagtgcaagacctcagaatcatcaatgaggcagtaattcctttatatgctgctgtacccaacccctaagccccgctctctcagataccagaggaagcagaacggttcactgttctggacctcaaggatgccttctcctgcattccccagcacactgactcccagttcctctttgcctttgaggatcctacagaccacacatcccgactttcgtggatggtcctgccccaggggtttagggatagccctcatctgtttggtcaggcactggcccaagacctaggccaattctcaagtccaggcactctagtcctccaatacgcagatgacttactttgggctaccagtttggaagcctcacatcaacagactactctagatctcttgaattttctagctaatcgagggtacaaggtatttaagtcagaggcccagctctgccaacaacaaattaaatatctaggcttaaacctagccgaaagaactagggccctcagcaaagaacaaattgagcctatactggcttatcctcgccctaagacattgaaacagttgcagggattccttggaatcgccggcttttgccaactgtgaatccctggatacagtgagaaggccaagccactctatattctgataaaggagacccagagggcaaataactcatctagtagaatgggaatcagaggcggaaacagccttcaaaactttataacagaccctagtacatgctccagccctaagccttcccacgggacaaaatttatctttatatgtcacagagagaccaggaatagctcttggagttctaagtcagacccgtgggatagccctacaaccaggggcatacctaagtaaggaaactaatgtagtagcaaaaggctggcctcactgtttatgggtggttgcagcagcggccatcttagtatcagagactatcaaaataatacaaggaaaggatctcactgtctggactactcatgatgtaagtggcatattaaatgctaaaggaagtttgtggctctcagataaccacctactcaaataccaggcactaatccttgaaggatcagtgtttcaaatatgcacatgtgcagccctcaactctgccacttttctcccagaggatggggagccaattgagcataactgccaccaaattattgcccagacttatgccgcctgggaggatctcttagaagttcctttaactaaccctgaccttaacctgtatactgatagaagttcatttaggtacaaagggcaggctatgccatagttagcaatgcaacagtacttgagagtaagcctcttcccccagggaccagcacccagttagcagaactcgtggcacttacctgagccttagaactgggagaaggaaaaagaataaatgtgtatacagatagcagatatgcttatctagttctacatgcccatgctgcaatatggaaagagagggagtttataacctctcaggggacacccattaagtaccacaaggaaatcatgaaattactgcacgcagtgcagaaacccaagaaggcggcagtcttacactgccggggtcatcaaaaagatgaaggagaagcagcagaaggaaactgccgaggagatgctgaggccaaaactgctgctaagcaggacttccctttagaagtgcccatggaaggacccttagtatggagcaaccccctccaggaggttaagccccagtattccccaagcgaaacagaatggggactctcatgggggcatagttttctcccctcagggtggttagcgacagaagagggaaaggtgctcatacctgaagccagccagtggaaaatacttaagaccctccaacaaacctttcatacaggttttgaaagtacccgtaagatggccaaatccctatttacagggccaaaccttctccaaactatgcggcaggtagtcaaggcctgggagatgtgccaaagaaataatcccttggtccatcataaggcccctctgggggaacaaagaatagggcactatcctgtagaggactggcagttaaacttcacccacatgcctaagtcaagaggatttcaatacttgttggtctatgttgatacctttacaaagtgggtggaagccttcccctgcacaacagagaaggcccaagaagtagttaaaatcttacttcatgaaataattcctatattcggacttcccccaaagcttacagagcaacaatggtccagcttttaaagctacaataactcaaggaatttccaaggcactaggaatacaatatcaccttcactgtgcctggagaccacaatcctcagggaaagtcgaaaaggcaaatgaaacactaaagaggcatttgagaaagtatctcccatggccactctcttgcccatggccttgttaagaatccgaaattcccctggaaatttgatccaaaatcaaagggggctcagtccatatgaaatgctgtatggatggccttttctcacaaatgacctcctgctcaatcaggaaacggccaatttggtcaaagatataataacttctctagcaaagtatcaacaaaaccttaaaactttacccaaagggtatgacaggagaaaagggatagagctgttccaaccagaagatctagtagtggtcaagtccctcccctctaccttcccatctatggatcccttgtgggagggaccatactcagtaatcctctctatccccactgaggttaaggtggcaggagtggaatcctggattcaccacacccgagttaaaccttggacaccccttgaggaacttacaggactatcagctcaggagtctgaagatcagccagaccagccttgatacacctgtgacccacttgaggccctgcttctcctatttcggaaggaagcatcccaggctaaaaagactcctgcagttaatcctaaagaagaaaaactcatctctacctaatagaggataagcagaaagcctacatggatctttgacatctctccttgctctctttaatggagtccttatactgtttcatcatattaaacagtatactaaccataccctttgcagtaggattatatactgtagctcctgccaggacaaaaatcctgaccacatcaaccttttttctatcgtccttccttttaacaatttactccttcttccctcctcctttctactaccgctccacctacagagcaccatgactccctttataaggatctcctaagcttcttttaactctcctaagtattctttctgccacctcttcatccctccccaactgcacttgcttctctagtgcatactctcctccccttcccagaaacactgatgtagtctacttcgaaaggatattgtttaaaactaaatcagggtttactacccacacctatatgagaaaggaatgttatagtgctgcttctctctgctcccacaatggccatacatatcaccaaggacaaatgacccagtccaactgtcccgatgccctagggactacccaatgttggacatattacacccatgtgggtataactgatgagagaggtgtccaggataaagccaaaaacaacatgtccaacaagtaattaaaaacttgatccaaccatctaacactccaagtccatataagaaactagacctttccgggttacaaaagactcttgactctcattcccatctctagagtctatttaacaccacattcacaggaatgcaggaggcctctcctaacaatccaactaactactggatgtgtcttcccttgcgtttccaaccacatgtcccagtagtccctgtcccaggacattggaacctatccacctcagtcctaaacaccaccgggataattggctccccagtcaccaatctgccagccacacaggcctcaaatctcacatgtataaattttagcatgactcccaatagaaacatctcccaaagtcaatcctggataccagtgacctcaggtttcacctgtctaactccagacatctttttcatccgtgctaacatagcttattgatgtctaaagggcaccccaaaagagttatgctttctctcatttctagcacccccatgtccatttataccgaacaagagttggaaagtctccttataccccagtcccgccacgcccgagcgcctattctcccttttatggtaggagccagaatactgggtgggcttgggacaggaattggaggtataacctccttcacccaattctattataaaatatcacaagaattaaatgatgatatggaatgggttgccaattccctgatgaccctacaaagccagcttaattctctgactggggtggccctccaaaaacgaagggccctagacttactaacagctaaaagaagaagaacctgcctcttcttaggagaagaatgttgctactttgtcaaccagtcaggaattattgccgaaaaagtccaggagctaagggaatgaagagaacgtagaaagagtgaactccaactctcaggaccctggagtatatttaaccaatgagtaccttggcttctcccctttctaggccctgtaacagccatcttgctatcactcgccttcggtccctgtatttttaacctccttgtcaaatttatttcctctaggataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcactctctctctcagtccaagtctctgtcactcgccgcagtcagcctccacaccaattctttggcgtggctaggcacagaaccttgggtgttacaaaaggataaaaagacaagatacagagtgcaagaaaatatttgcaaacaatgtatcaaacagagtagtatctaaaatatataaagaactctcaaactcaacagtaaagaagaaaacttctgggcacagtggctcatgcctgtaatcccagcagtttgagaggccaaggtgggtggatcacttgaggccaggagttcaagaacaacctggccaaaaggtgaaaccccatctctactaaaaatagaaaaattagccaggcatggtggtgggtgcctgtaatcccagctactcaggaggctgaggcaggagaatcacttgaacctgggaggcagaggttacagtgagacaaaatcccgccaccgcactcctgcctggacaacagagcaagactccatctcaaaaaaaaaaaaaaaaaaaaggaaacaatacaattaaaacacaggtaaaaggcatgaagagacatttcactgaagaaaaaagaaaacagacaagtgggaaaataagcatatgaaaaactggtcaacattacagtgattaagacctggttttcaggccagcatgtgagaagcctgaaagtcattatctaacaagtaaaaagctgaacaaagtgaaaaagcaacaactcttcttagatcccaaagagaactgaggtcacagtgcaaacagctgctcccaaaacagaagagagcaacatggcaaatgcatagaatacttattagagcttgaaacttgtgtgggacacagcacctaggtgggaaaacttgaattgtattaattgctggaggctgagtatgaagaagtctgagagttaaaaattccaaaacgaccccgtcatagggagactaccagacttttacgagttttacttccaggagtttgacctggttctcacagtaagtatcagagaaaaatcccctcatgactccagaaaagggaagataaaagggtccattttgaaatataccagaacattctattcttaataaggtctgccctcaggagaaactatttaaccagagcctaaactctttgtagttttaacagagcctaacttaccttggggaagagaaataaccaactccagtcaattctagtcttccgggtggttaaagggaaatacccaactaaagctccctgtagccatcctgtcccactcaagttagtaaaaacagaaaaaaactgagaagcatctgtgaagttacaacccaggggcaccggctcactaaaacactgaggccaaatcgtaggacacttcccctccccacacaccttaccaccacattactaaaggtctgctcaccagtttcttttacccagtatatcacgatcagctttcaaaaaataaaaataaaaagtacaaggcatactgtaagacaaaaaaaaaatagtttgaagaaatagagcaagcttcaggactagactcaaacacggcagggatattggaattactagaccaggaatttaaaacaactatgataaatagggtaaaggctttaattgaaaaagtagacatcttccaagaacagacggataatgtaagccgagggataaaaattccaagaatcaaaaagaaatgctacagatcaaaaatactctaatagaaatgaagaatgcctttgatgggatcattagtagactggacttggcacagaaatctctgagcttgaagatatgtcaacagaaactcttaaaactgaaaataaagagaaaaaggctggtaaaaatggaacataattatttaattaaaaaaaaaaggagaagaaggcagaggctgcagccagccaagatcacaccactacactctagcctgggcaacagagcaagactccatccaaaaaaacaaacaaacaaacaaacaaacaaacaaacaaaacacattatatccaagaattgtgggacaactacaaaaggtatgccttacacccttcacaaaatttaactcaaaatagatcacaaccctaaatgtaaaacacaaaactataaaactcccagaaaataacataatagaaaacctagatgacattggttatagcaatgattttttagataaaacggcacaatccgtgaaagcaacaactgataagcttaacttcattaaaatagaaagcatctgctctgcaaaagacaatgccaagagaataagacaagccacagaatgagagaaaatacagtaggccctccatatccgcaggttccacatctgcagactcaaccaaccgtggatcaaaaatattaacaataaaaataatcaaactttaaaaacaatatagtatggcaactatttacacagcacttacattgtattacgtattgtaaggaatctagagatgatttaaagtatacagaagtaagtgtgtagattatatgtaaatactacactattctatataaaggacttgagcatcctcagattttggtatcaggggtcctggaaccaagcctccacaataccaaaggatgtctttatttgcaaaagacatgttcgataaaggcctctcatccaaatatacaaagaactctaaactcaacaataagaaaactaacaacccaattaagaaatgggctttataaagacctttacagagacctcatcaaagatgatatacaggcagcaaacaagcatatgaaaaggtgttccacctcatacatcatcaggaaaatgcaaattaaaacaacaaaatactacacatttattagaaaggcaaaatccagaacactgacaacaccaaatgctaagtaggatgtggagcaacagaaccctcatgtattgctggaatgcaaaatggtacagcctctttggaagacagtttggtggtttttttacaaaactaaatatacaaaattaaatatatagaaaactaaatatactcttaccacatgatccagcaattgagctcctaagtatttaggcaagagagttgggaaccaaaataaaagtcctaacccttccaacagactactggaccctcctttagctaaaagaccccaaaattttaagttagcagccatggcaagacagtaagctgttcatgatccatttgcttccaacccacttctctcctttctaatcactggattttctcaaaagccagtgtgagaaaacaaaagtccaaaagaccccttcgttcaagtcatctaaacacaccccctcctgtttttatagtttcaacatgacaactattttaggccacaaagattttcttcttgataagtggcttttggaagggactggttctggccagtcacctgaggatgcagtttatggacttcttccctacatttcaccttttacatatagaacctaactacaatgcatttaaatattaaatctccacctcaaagtgattatgggaggtattttacatatgagtaaacctaaaacgcatgtgtgtgggtctccttcatgaatattcatggttccttctgtaacctgttgaatatagctgtatgcctagccaatcatcagcataagttcttatcttaaaccctcaccttactggaccccactctgcctggaaatgcctctcaatttctgctgagactatgcctcccagcctgtcagaatggcctatacaagctgcaaacctttgtgagaaatgaagctctcctttccaaatctatgaacctcatcattcttcagctgacagagttgaaagctgacatccacacaaaaacctacacacggctgtttacagcaactttcctcataattgccaaaacctggaaacaaccaagatgtccttcagtaggtgaatgttgataaactgtggtacatccagacaatgggatattactcagcactaaaagcaaatgagccatcaagccatgaaaagacatggagaaacttaaatgcatattactaagtgaataaagccaaacccacagaatatacaacaccaaaagtgaaccctaatgcaggggtccccaaaccccaggccacaaaccagcaccggtcagtggcctgttgggagcccagctgcacagcaggaggtgagtggctgcaggtgagtgagggcagctgagcaccacctcctgtcagatcaatggcagcattaaattctcatagaagcacaaacccactgcacatgcaagggatataggttgtgcgctccttatgagaatctaatgataaatataatgcaatgcacctgaatcatcccaaaaccaaccaccccactccaccctggtccgtggaaaaactatcttccaccaaaccagttcctggtgccaaaaaggttggggactgctaccctaatgcatgaacactgggtgataatagtgtgtccatgtagttttatcaattgtaacaaatatactacactagtaggagataatgacattggaggaggctgtgcatgtgtggggacaagagatatacaggaaatctctgtacctcccaatgaattttcctgctgctctaaaaaaactgctctaaaaaatacagtctattttttaaaatgagacatcactaccacaaggaaataccattatactatcaaaatggctaaatttttttacactaagtggtagcaaagataaaaagaaaactagatcacttatacatacattgctgatggaaatggtacagtcactctagaaaactgtgtggcagtttctttaaaatctaaatatgctactacacaatccagctactacactcctaggcatctactcacccaaagaaatgaagacataggttcacagaaaaacctatacccacatgtttatagcaactttactcataatagtcaaaaactgaaaacatcccaaatgtttttcaataggtaaatggttaaagtgtattctctccaataccaccattactgaatgctactcatcaataaaaaggaatggactgttgatacatgtaacaactggatgaaaatccagagaaaaaagccactttcaaattccagttatgattccatttataaagtattcttgaaaaacaaaactatagaaatggagagtaaatggcttccaagagttaagagataaaggagagggggcagagagagaagtgggtgtgggaaacatgaggtatgtggaaatgttctgaatctcagctctatcaatgtcaataccctggttacaacactattatttcttaaaactgtatataaatctataattatctcaaagtaagaagtttagttaaaaagatgaaggaaaaactcttatgactagagggacaattttctttttttgagatggagtctcgctctgtcccccaggctggagtgcagtggcacgatctcagctcactgcaagctccgcctcctgggttcacgccattctcgtgcctcagcctctcaagtagctgggactacaggcgcccgccaccacgtccagctaattttttgtatttttagtagagacgggatttcattgtattagacaagatggtctcgatctcctgacctcgtgatccgcccacctcagcctcccaaagtgctgggattataggcatgagccaccgcgcccggtcgattagagggacaattttatttgatatacagcaacactgaacattattaaatattcaaacactataattttcagtatgaaacaataaaacatatcccctgaaaattcttgtaccacaaccactcttcaaagattcatatataaacaataagaattttagctcaccttccacgctatcagaacaggaagttccaatgccagtgtctccactgtcagaagctatactgtgtctcctgatatggttatttcgatggttagatggaacagttgtggcctgccacaatgattcattagcaggtagccatgctgatgaataatctgggcctaaaaagggaaatatgtaacagttaacacatatatctgagtaggcagaagattttttttttaccttgtggaaaatacacatagggtataaaaggtataaaaggttcttttctgcccaaaataatttaaaatgatcaacaaaattaaccaaataaatgtatatatcacacatatatcaattaagtgtgattacatagcttcctctagctgaagaactctgttttctgcttccgggcattaaacttttaaagacgtactgctgtgttattaaaaatgttggaactatccacttatcttcaaatgtcagtactctgctctagaataattgataggtggcatctgtgattatacatacatgcgttagctgaaaatcagggctcaggaaaattcaataataatgcatgataatataaataggatatccacatggaatatgaaaacaatccatttttttctgctatatatctactaaattttttctacaatcatcacttaaaatttttaaattttacattattttatttgaattatttccttaattattatttaataacagtttaatagcacagcattttcctactcttagcttgatttgtctttttttttttttgagacgagtctcgctgtcacccaggctgggtggagtgcagtggcgcgatctctgctcactgtaagcgctgcctcccgggttcacgccattctcctgcctcagcctccggagcagctgagactacaggtgcccaccaccacaccccgctaatttttggcatttttagtagagatgaggtttcaccgtgttaaccaggatggtctccatctcctgacctcgtgatccacccgcctccgcctcccaaagtgctgggattgcaggtgtgagccaccgcgcccagctagatttgtccttttaatttaaatactttttagctaatttaaggtttttcaatgttctttcaatgtttatttccacttactcacttttacttaacttttatttgactttttctgttttacccatcacttattttattgtctagtacagtgctactcaaaggatatcaatggaccagtgccaatctgtactatttgttacaagttagatgcagaaataaataagcatctagaaatgttattgtactataattagaaagagaaattttaaattcgttcaactttacataaaacctgtagaagcacaaatctttactaatgcctaatacagtaagtctcaattcagggcttacagaattattcataaaagttaagaagttcccctacatgaattttaggctctcatttcaatgacagttcttaaaaaattaataagcacattacagattatctgaacagccaacttaaaacattatttccacataatttcaatgctcccgtatctgtatagcagccttaaaaagatttatcacataattcaatgtccccatctgtgttttgcggttgaaatagcagttgcttctaagtaaagagcaaatgacatcactgggtatttaccattatttgaaagaagatagctttacagaattattcattgataccctattgaaaccggcatgcaaggaatgccttctggcagtttaaacataagggtaacaaaacaacaaacgtgcataaaattaattataccagtttttttaaccacacttttaggattagttgttctctatgtcagtattaaaatcaaaatatataaacaaattaataaaaccagacctaaagctacctctatcatactaagctcaacattaatgattcacttttaataaaacattgtcacattattttatttaatgcatttatttatttaaatgcaatttatcaattaaatttaggctttatacatgtataaagtatataagcagccttaaaagccttatacatttaaattaacaaatcaaatttgaaaaacagtggccaaagagacacttttaccagctttgaggttcagaacaaccacttaaagctttgtagattctagacttctctcagaatgagacttttcaattcaagtgattcaacactcacattaaagcaccagaagaaggtgttctgtcaccagatctattctaattctgatctgtggtctgtaatctataccaaaattttttttcaatcaggtaacatcccatctaaatgagctcaaagtcctgcctaaactattatcaaaaatggcaaccagcctagtctcacaagtgcaaacctattagctggataattatttttttttaagaatacccagcaaatagcataaataggctgggactatatgtaaatgaaaaaataaatataagaaacgatgccaaatctcactaatggtgggagaagtgaaaaagacaataaattttctggatttttaaaactatcaagttgataaaagaaagactggtgtcaaccaagtgaggggaatgttcgtatatttttgtggccttgcaaattggtacaacctttctaaagggcaaactggaaagtggtatctaaatgtcaatatagacatgaccttctactgagaatttatcctaaggaaatatcagacaattacaaataaatatgagtataaggacattcctgacagcactgcttaaagtaaatgcctatgaacaaaatataaactgttaattagttgataatgtttaagtgctaaaaatgattttatcaacctattttttaacatggaagaacatccagaatatatctagtgtgtatggaagagaagcattttatgtagctatatacataatatgattccacagctggagaagagtttgtacatttacatacatggaagaagctttcagggagctctatatctaaatgctaacactgactatgttttactaaaggaagaaatacattacaggaacatttactccatcattggttattattattattcaatctaccagtttatgtggggaaatgctgaaaattatgcatactgatttgcagattacatcaacatttgattctgagattagaaaccagctatagctcaagatacgcaaattcagattcctagtaacaatttttacaaaagctgcataaaatggctagaattaaaacccttgcttttaggcaatataactattttgagcagtataaagtcatgctccattaaagcctacaacacacctccaccctattgattgttgacaagtcttggccaataaaccatttgtggattaaaaggcaataatcattctctctctcactctctctccactcactcactttctcactccagtaatggggaggaaagcccactgtacatattaatgctatggtgttattatcacaagctaggacaaccttcaatcattagtcttgtataattaactattgccagaaaaacagttcaataaaacctttttctgtcaagagccagattgtaaatattttcagttttgtgggtcactcaatctccgtctcaactagccaattctgccactgtagtctaaatcagctgtagacaataaaatggatgtggctatgttgtaataaaactttatttacaaaaacaggtgacaagtccaatgaaacctgggggccagtttgcagactcctgagatgtggtaaaaaatcattctaactgaaaagagtccctaaaattcaactgattcataagtaactacagccagcatattaattcatttctttatttggaagaaaagtgagctcatcctagagtacatatcagcaagccaggctgcccagaatctgacaattcatgaaagcactactgaggtttttcaaggattacaaagacaaataaatgtcaacaagtgttttaggtttctttttccagaataaatgatctcagtttatccatatggtatggaactcctggacaatgtcaaatatgtgtgatggttaattttacatgacaacttgactggaccatggggtgcccagatatgcagtcaaacattacttccgtgaaggtgtttggatgagctcaacattcagattggtcgactggataaggcagactgccctccataatgtgggtgggcttcactgaaccagctgaaggcctgaacacaacaaaaaagctaaccatcccctaagcagaagagaattcttcctgcctgatcccctttgattaaatacactagtacactggctttttcctaccttcaagcttgaactgatctcttcctggggcttgagcctgccagccttcagactggaactatgctatcaacaatcccaggtctccagcttgccaaatcacctcacagatcttgggacctgtcagccaccataatctcatgagccaattcttaattaattaattaaatgctattggctctgtttctctggagaacttcaatacaatattgggaaaactagaaaaattctaatcttgcctacagatatgaaaaagtggggacagccttctatttagaaaagaacaatagttgtaatcctcaatttccattacagtatttcaatatcatctactcaatatgatacctattccacagatttccaaagcacatcagtacaatctcaactatctgttatctaacttttatacaaaaaaagctataagaaatgacagagaaaatggtctaagacatgctatcattccgcccctctagaaaccctaaattctatctttgaatcacagagcagtacatacatacttagagcctttttatttagcaactcagggaaatgatcttcctaaaatttctttcagtgtactgccaccttataaacttgaacctctgacttttacagaaggacacaaaaagtaagcaaaccacataaatcatcaaattgttgtctaggccgggcaaggtggctcacacctgtaatcccagcactttgggaggccaacgctggcagacagcttgagttcaagagtttaagaccagcctggaaaacatggcaaaagcccatctctacaaaagaaaaaaaaaaaaaaattcaaaaaaatgcctctgtgcatggtggcacatgcctgtagtctcagctacctgggaagctaagctacttgaacccaggaggtggaggctgcagtaagccgagatcatgccactacactccagcctgggtaataaagcaagactgtctcaaaaaaaaaaaaaaaaaaaaaaagttgtctatatatttaagaagttaaaggcaaacactaaaaatatttgcagatatggtattaatgcataattataaagagatcataagcaaactaaaaataaataaataaatactaaatggtttagtctaaatggacaaaggacaaaccccaaagggaaaaacacaaataaaaaattctgaaaaatagtccaagcccactggtaagcaagtagtatcaaattcagaagacatgctatttttcagctatcaatctagcaaaaatgttaaaagaacaaaacaacagtgttcctagatactcccatacactgataatggtaatgttaatttattcattacaaaaacacaaccttttgataggctattaggcaatatacatcatgtgtagcacatgcctgtaataccagctactcaggaagccaaggtaagattgcttaagcccaggagttcgagaccagcctgggcaacatagtgagaccgtctcaaaaaaaaaaaaaggaaaagaattaactatataaattgatctcctcccacctgaactaatttgccttaacctttaaacataactatgtctttaaaaagaagatctggtattgtatgtgcctcaaacactgaagatgattaacaaatgtcatgaaaataacattctaatcttttaatttaaactgaaaaaattcacagtctgaaaagaatgacatgacttgtctttagacaagtcaatccagaagcacaatacaggaagaagtacatgtgaaatatgctgaccaggtgatttaataaggaaaattttctcacagaatagttacaagactatgttactgaaatgggaatattgatatctagtatgcaatatgcacttaaaaactcaaaataaggctgaataacctctggcaataatgtcttacctaaagacaaaaggactgctgtaagaacagcaaagatcccaagaaactctacattggaactcctccttggaagacaatatgttacatttttcaatactaattttttaatactaattttaattattttaatagaatactgagtgcctgcggataacattaaaaattctgaatatttctcagacaggaagattagcattaaataaaaaagcaacctattttacttctgaagctcttttattggaagcaaaaatgcatacagtatcaagtattccacagcatttgaatatatatgtaactgcactgagaacaagaactactctcattgaatattttaatgacagctctaaattgaagaaaataaaaataacactactgacaaagcagatttatacttttaaataagctgaatacataatacaaatcgagaatacaaattgcaatgtttttcagaatgcagattatctgtcacccattagtatgttttaaaatcaacttggaaaccaacactttcaaataaaatagtagataaagcatgtttacccttatattacataagtagcacgcggttcacattttaacatctctgaaatattaacaagtacttttgcacaaagaacctattctgctgctggaataactccactcaagccagcctctactctactatcttctagaatcaagcatgtttatgttattcttctacttacatagatctgtgagccccttacggcatattaaataaattcaaactccttaagttaggcaaagttcttcaccaattgtcagcttcactttgcaacttctacctacaaaaactatctagccacacttacctaatcacttcctccaaacagatgagactctttcatgactccaagctgtttcacttctgcaccttaagagtcctagttcagaattaacttgttctgtcttccctgattcctccaggtggcattaaatactttgttcactcccaatatattattcaaaattccaacaacatttaataaattatattaacccatatgtatatgactttcttctccctcaccaaactgtgaaaaatgaaaggcaactttttttagtgtccagtacctagcaaagagctgcacacttatacagggtctcaataaatgtagtcattataaccactggatacctaacaaatgttcacagaataaaattagaattttggaagccttacaattacaactacaaaaatatctttgtgttcagaaaaaggattcaaacaagcgttttgtttggtggttgttgtctgcttattttaaaatccaggatattttaaactatcccttgagccagtatgcatttaagtatctatttagagatcagtaaatatttatcaatgcagctttttttaaggtaattttaaataatttagagatctgatggccaacattcctaacatgggaaaacagtctccaataggttaaaaagacacaaaactcacacaaaaaattagaacattaaacggtaagaaaaaaacgttcatattaacagtagccaaacagaaaaaaccaacaaatctggaactacactgcagaatatctagctaagatgacagaaacatcacatagtgttattttctccatcccaatcctccactccatttcagtactatttatctctagggtaagtgactccaatagtcttagtttgtttcttttatcacagaattaccagtatagctcagtgtgcactgtgaaaccaggctacctgggttcaagttcattctacctcttattagcagtaagtcctcataaatcacttaacctctctgtgcctcaatttcttcatatgtaagagaagaaaaaaattatagaatagtacctatattatagggttgttgtgatcaatgaacatgtaaagttttttgttgttgttattgtttttgagacagagcctctctcagttgcccaggatggagtgcagtagtgcagtctcggctcactgcaacattcatcccccaggttcaagagattctcctgcctcagcctcccaagttgtgcggattacaggcacacaccaccatgtctggctaattttttaggttttttttaagtagagatggggtttcgccatgttggccaggctggtctcgaactcctgacctcaagtgatccgcctgctcagcctcccaaagtactgggattacaggcgtgagccactgcacctggcctgtaaatatatttttgaaagtgccagacatataattaggatctcaataaatgttattatttttattactgtccatgcatagaaattttccagaaggataactaaaaactattaaaaatggagtggaggactgacatgaaaggtagataaaaaagcttacttcactttaagcttttctgtactgagtcaacattttactgagcatgtgtaactttaataatgagaagaaaaaaatcatctgacaaataccacataacaataattcttctgctcctcatgaggtacagtaccccactctcttccaagtttttaaccttgctcttttccctccctatttaatcaaggacatctacactgtcaccagcttctctcttaatatcttactagcatgtttacaactacttatctccttcaaaacacaaacccaatgcccatctctctgataaccaccacttttttaacatcattccaagagattaagcataagctttctatctctatgatctgcaaagtgaatacatgcatgccagggagtacacgagccaatccactggcaagctgctggaagaaaaaaacttgtttatactgaaaattatctttaggaaaaagtaatgcattaaattttgctataatatttaacatacaggttaacactagtgcccttacttggattatcagagcattatgttacatatatataacataaacggaggtgctctatacagagggcttgacggtgacatcctcctttgttcatttgattttttcgtatgggtatgcattgcagttcatggctggttaagcagatttgcatatcgataacattaggtagttttacttaaactagccctcacaaaatggatttgtggctctatattactgcaaagaaacctgaagttgaaaaacctgaagataatactaaaaatgtaagtataaacaaacaagaaaatagtcaagctgatgcctcccatgcacacacttcaacattccttttgcaagagaaaaaaaaaaaattacaaaattagatctgacagtaatatgtcacctagcatttctgtttgaaaaaataaccattgatccccataagggtaaagatgatgctttcaaatgaaacgttcaatatgtagagggcatactggaaatcaacatgactcttgtatctgcatatgcgagttggaaaaaataatttttaaaatatatcaactgtatgtaccactaaaaaaaaggatgccaattaaatgacaccctgaattacatgatgcatccatatatcagaaatgctaaaacatttttaaagtacattttaaaattgataaagtataataaatattgcatacataaaataggagcatttgggtgaaatttttgctgttaggcatgtctaaaaaataaggagtccattggttctctatggtctcaaaacatttgctataccctaccctttttatgaaaggtttgtaaaatgtgtcaaaaaaataaaaataaacaacaggtagcaaaacggggaggtgaattgagaaactgtgctgctccaatcccaaaagagatccaaagatctgctcagacatgaaaagttaggttctagccagaagtaaaattctaggccagaagaaagtaagaatcaagaataaagtaagatcagattccaagattgggaattaaacttaagcagtcactgaagatgctttcactcagctaaaataaggttagcagcatcaagtaagtatactttctcacataaacacactagttaaaaaatacctacattaaaatctagctcaatctaagctaataggctttcttgggttgggcacggtggttcacatctgtaacaccagcactttgggaggctgagcagggtggatcacctaaggtcaggagttcgagaccagcctggccaacacggtgaaaccctgtctctactaaaaatatatatatataataaattagtccagcatggtggtgcacacctgtaatcccagctacttgggaggcggaggttgcagtgagccgagatcacaccactgcactccagcctgggtgacagagagactccgtctcaaaaacaaaaaaagctgtgttcaaaaaagcattttggcaactattaggaataacagccacgtatttagtttttggtaagtccttgttcctgtttaaaaactgggaaaataaggtacagttaacaactaatgaggctgttcataaaaccactacaaatatatacaacttggtatttcagacgggcttatctttgtcctagaacataagaatcatacacaatacatttaaatggctaaagaaaaataaagtcttaaaatattacaaaataattgagaaaatttataaatatatggaagttttctgttcccaaaattaaagcacttaacttctagtccaacttttcagtacattattcctaaaatgagacagaatgctcagtattaatgagaatgctttagaaaagcttcagaaatgtcatagcaaggccatatatatgtaatttcttatggtcaggaggcaatctctgcctctacaaaagcaatgtaatcaactggtagaaaatgctaaactacatgaaacatagtccaaatctttcatcccaaaatctttcagagaaatatataactaaaaactatagttcatttcagaactctaaactttaatactaaaaactattttcaaaacgagtatcaataaagcaaataagtttcattcactagacattaacagtgtagaaaggcatacaacagtttctgatcttacattaactctctttaaaggaacttaaaatcctatcaacgactttaattaatttagcactacctaatgaagtctttaaacaatttacagcaggagaaaaaaaacaaaagtaggggtagagttacttttctgaggtagattctcagatcagacagaggttaagaaaagcatgaaataaaactagatacagtactaaagtctggttccctgattgagagaatcttctattctgaggggcgagaacactgttaacaccagttcagacgccctgagcagacagagtaccctggtcaagacttggccactgttcagtgtaaggaatcccagaaaacccttcagtcctaggcaacctatgacacacaacccctagttttaaaactgaaacgtcaggcaaacccagacaactggtcaccctagcttaataagtggtaaagagcaattcaaacatttattaagcacttatgtatcaatccttatgcaataaagtcagctccactggattagataatctctaatttctgctaggtttatatttttaagtatctcactgaaactggccaaatgcattgatgcattttcttctgactcatcttacatggctgcctggaagcatgagactggtgatcactactgccttcagactcctctctaccagaacacttcattgtcctgcttttactcctaccaccctggctgctccttctcagtgtctttggacggcacatcttcctctgcctgaagagaaaatgttagtgtcccagggcttagtcctctactgtcttctctattctctcggtgtgatccatgacctttaaacaccatttataaccaagtaattctcaaattcctatctctcacccagcaacctccctactgagctccagcatttatacccaacttcatattcaacatctcacctgaatttctcaaaaggatctcaaatttcacatggccaaaaagaactcttgattccatttattttccttacactctctccccaccgccctctgcccactaaccttccccatctcaggaaatggcatcactatcgattataatcacagaagccaaaatcaagatgtcatttttgactcctctttcccttaattgacaactccaaaccatcagtaaatccttaagatttctcatgtatataccaaatccattttcttctctccaaatccaatctaaccattctaactcaagccatcatctctcacctaataactgcaatggcctattagctgtcttccctactgctgttcttgccccactcctctacaatttcttcttccacagaatagccaagactgattgtaaacacctaggacaaggaatatctgttccatgtccccaatacatgggaacagtatctgcctcatagtaggcactcaatgtgctcaggagtgaaagaatgaagtcactccccggcatcttctgacatgcagaatagaatccagactccctacaacccctaacattattatcaggccttcctcacctcacagtcctgctcactaagctccagactcactggagttcttcaaacttctcgaactcatttccgccttggagattttttgttccctccacctgaacacttctcccttcacgtctggcttcttctcatcattcaggtaacaatgttacctcctcagaggcctccctgaccagctactcaaggagctctgcccatcctctgccacctcaccaatcttcttttcctcttagtacttaacactagctgcatcatctcactatctgtttacttactgatcctcccctctaaaatgcaagccactaccaggcagcatggtggttcatgcctgtcatcccaatacttggaaggcccaggcaggagatcacttgagcctaaaagttcaagaccagcctgggtaacagtgagacctcatctctacagaaaatacaaaaattagccagcagtcagtgcacatgcctgtattcccagctgagcctgagaggctgaagtgagaggactgcttgatcctggcaggtcaaggctgcagagacctatgattgcacaaccgcactccagcctgactgacagagtgagacactgtctcaaaaacaaaacaaaacaaacaaacaaacaaaacctaaaaaatgtttttaaaagtaaaatacaagcctccgtagagcaagaaccttatctttcttgttcaatgatgtatccccagaggcttatacaatgtctagcacaccatatttattgaaagaataattcacaaacatttctaatgccaaggtaacaagcactatgctaggtaaccattttttttttaattaaagaaaaacagaaatcaaaatattggtatgaaaagtaatttggggccaggcgtggtggctcacgccttaatcccagcactttgggaggccgaggctggcagatcacgaggtcaggaattcaacaccagcctggccaatactgtgaaatcctgtctctactaaaaatacgaaaattagccaggcatggtggcacacgcccgtagtcccagctactcgggaggctgaggcagaagaatcacttgaacccatgaggcggaggttgcagtgagccgagattgcgccattgcactccagcctgggcaacagaacaagattctgtctaaaaaaaaagaaaagaaaagtaatttgatgttatttttatgttgatcatgcccatccttaaatgaccctatacaataaattgctcttcttagaatattactttgccagtgtaaaatatgaaaatcctgatagtaataataataatgaataacatgttattgcttaaaaattggctgggtgcagtggctcatgtctgtaatcccagcactctcggaggccaaggcaggcggatcacttgaggtcaggagttcaagaccaacctggtcaacatggtgaaaccccgactctacaaaaatacaaaacattagccaggtatggtggtttacgcctctaatcccagatactcgggaggctgaggtaggagaatcgcttgaaccccggagacggaggttgctgtgagccgagatcgcactccagcctgggtgacagaatgagactctgtctcaaaaaaaataaaaaatgatattgcttaaaaagtgtctgatgatcacgttcttcactttcttaatgcaaaatttatgtaattaggctataactcaggaaaatactatccagaagactttatgtcttcatcatcttttcagagtataaaaatacacatttcatccagtctgaaaaatcatgactctctcaaccctttctgttcacacacataaatattacaacatgacaatagaggttatcaactcaccatttattgcttggcctcagattaatttaccagcttcattcaagccaggaagtgatcaaattccaattattaatcaagttcatttcaccaaagtcatcactaaagttaagattcaccccttaccccccaatacctattatgaaagaacatgttcagttgggtttaggccagagttatgtttcattgttaccacagtattcctagaagtccatctaattcagaaccacagcagaaaacaatattattagttgtaaccataccagttattaccactatcattatgacatcactaaacaccttatggcaagcatcaattaagaggtaaatgtaaagctcaaagcaatgaacaaatgacattttttcagctcaagtgtttcctgtaacattttattttcgcacactataaaagtataatactctacctcaaaatgttttaagagttgaatatatgttttcgcttttgttttttaaagagacagagcctcactctgttgcccgggctggagtgcaacgacatgatctcagcccactgcaacctcagcctcccgggttcaggcaattctcctgccttcagcctcctgagtagctgggattacaggcgcacgccaccacgcccggctaatttttgtatttttagtagagactgggtttcaccgcgttggccaggctggtttgtaactcctgacctcaagtgatccgcccacctcggcctcccaaagtgctgggattataggcatgagccactgcgcctggcttatgttagtattttaaaaaaattatttacgaaaaggaacatacttagcacaactaggtattaggaagtactcaaagtatcactttatcatgcttgatttcaaaagcctacgggaaatatgtctatccttcatccaacttgaaaccagtatacattctgaacaatagggtaatctcaaatgcaatcaaccaaatgcataaaaagataccaattgttctattttaaattagccttctaaccacacttgccaatacaaaaaagagaggcttttatttgatatttgtaaggaaacttaagaaaacactcattttagctgggcgcggttactcatgcctgtaatcccagcactttgggaggctgaggccggtggatcacttgaggccaggagttcgcgaccagcatggccaacatggtgagaccttgtctctactaaaaatacaaaaattagctgggtgtggtggcacatgccggtaatcccagccatttgggagactgaggcacgagaaccgcttggaaccgggaggcggaagttgcagtgatccaagatcgcaccactgcactccaggctgggcaacagagggaaactctgtctcaaaaaataaataaataaatactcattttatttttggtttataacagttactccaaaaagctgaaaaatgggaaaagccaaattaaactgaatcctaaagcgaaggctaaaagttcagtatttttcaaactacacttattattcctattttttactgccatttctttaaaaaaaaatttcttctgatttttagaaagtggttctataagccgggcgcggtggctcacgcctgtaatcccagcactttgggaggccgaggcaggaggatcacgaggtcaggagatcgagaccaccctgggtaacacggtgaaaccccgtctctactaaaaatacaaaaaaataacccgggtgtggtggcgggagcctgtagtcccagctactcgggaggctgaggcaggagaatggcgtgaacctgggaggcggagcttgcagtgagccgagatcgcgccactacactccagcctgggcgacagagaaagactgtctcaaaaaaaaaaaaaaaaaaactaaagtggttctatagtacctttggcttttcctttagtctagttatatatttgtataaacaaataaaccagtttcaggacagcttgaattaatccacatattaagataaactcattttaataccagaaattatttacttatccctgccttcacactttgttttcagacaagtccaattttagggctggaataattgctcaaattattcaaaagatatactgaacaatatttcaaaaataaaaatttccttccaattatcaggaaaaaaggtccctacatgaatcaactcagaggtcattatcttgaccttcaccatctgctcacttgcacaagaagcaacacaagtttttcatctaaggtagaactttttaaaacttaaaattatctaagataattttaaatatttatatttgctcaaaaagggaagaaacacaataaataattacattactatttcagcatgtaactgaaaaaaaactttacaaaggcatgtcctgacttgtcaatagtttattactgacaaattgagataaaatacatactttggtacagctatactgtccaaatttcttcaattagggtagtaattacaaagtatcctcttccactattattctatgccatagcaaatgtctctctagaggctgcaacataacaaagtccttcgttacctaactttaaatactaaaatgttctcttcttcctagaaaacaatgaaaaatagacaccatgcctcagtgatatacctccaaacaagctgctattatcacgaataaattttaataggttagattgcaaagacattacagatggcttttgacattttcagataaactgaaaccactccctccagcccctagggataatgaagtagcttctcaatcactgaagttacttagatgacaggatttgtgaataatctgtaaactcgggaaacctctgaactgtctccttaggacaaataacatacaatttagaaaaaaaaaatccctacttaatactgctttttactaaattcatgcctacattaaatttcaggatcaaacttaagtgaatgattcaaatcattcattaacatacattaagtgtttcaggaccaaacttaagtgaatgattcaaatctaactctggctttttaaaatgtacatatgtctttttaaaaaccacacatcacaaatatctaaactatcaaagaattgcattattcgaaatttcaatagcctgatactagtgactcggtcagtgcctgattttttttaaatagcagaaaatattaccatcaaaagacccctttccaaatgctgcttctgcttttttgttttgtaaataacagctttggaaatgtatgcaaaaatatctctaagttacacaagtcgagctcaaacactttgtggagcaaggttacttaacaggagtcccagaaacagctaaaattgtagggaaaattttgcgtatgtatatatggcattgttttttctgcgcagaatgtccatataactcagtttctcaaaaggcctcaaaactcaagattaaaagtgcctggaaagaccatcatctttagagaacatatcacaggcaacccaagacttattttttatcccaagttaggggaggatttatcctaattttgtggctcctacacaacttctgagcgacgcaagcatgaaatggctgtccgatacaaacagaccccttcagatacggaatgcagcaaacccctaattttccttgaaggggccacggaaagccaaacggattcgtaacccggttgctcaatggtccattggctactgcaggacgcgccctcctcttacgccgcaggggctgcggggcggcgaccaggttcctccgaggggctgaagttcccttgggggtggctgagagcggccgcatctctggcagcatcctccctcccgaaaacgcgccctaaaagtagcggctgcgggcgtgggcacagccaaccccagcctgcgcctaccagaagtcgggagggcgcggaactgcggcccctccgagacgcgcccgggccgccgccgcagcactgtcgcagcgaccttcccgcccgggtccccgcgagcaaacgggcaagccccgttatcacgcaggtcacacaccccacgagtaaaaggaaaaaaccgggcagacaataaagcccaacccgcgggggcccaagcgagctggaagttgggggcgctggggctgcagcccaaggaggagcggcggggacgacgggatgcggggctgatgcgcctgggacgcggcaagccatatgtcagcccgggtgctgacagcggggaggacactgggcacgcggcggcgtcggggaggcggccggggtaagacaggcctgaggcgggaggggagcggcggcgaggtcccgaggcgccgcggtcggccgtgacccccaccccagccggggcgctgtcccgttccttaccggcagggaagctgcgggctccgccggggctatcccggccgctggcctccggagccaggaagcgcccccacatcgcgggcgagagggccgggtgggccagggacgcccgactcctcacgtccgtcctcctgcttcttcggcggcggaaacttgcgcggagcgtgggcctcggcgacacgggcaggaggaaaggcgggatggctggttaacggctgctcagctacgggcggggagcgcaggggccagattcgccgcactgccggcgcctgccatggccaagccggctgggctgaggcccgcgccggggaagcggcgactcggcggtgacggctgctagatccccggctgagcccaggctcaaaggctccaggcgaagttgcagctgcgggttctctccgccccctccgccggcagagccagagccggggctggggccgcgagggggcggggcctcgggcaatgacttcaggcgtgcgcggcgccgcgcggggcggggactgcggggggcggggactgcggggggcgggtgagctaccccgaccccgcttcgcctccttggcggcgactgggctgtcccgccctcccgccgcatccctctgtctccatcctcccgccctgcgagttgagtagagggcagcgacttggcctattttgcgatactcgcccctcccttgggtaatccctcacgccctccctccgggcacctctgtgaagacacgtggaagacctgcccctggcgtcacaaccgctcgagatgaaaaagccaagccagggcgcggctgagggggcttccagcctcccttggaattaggattgggatttaaatcctcatctgtattccttcgtttatagattactttaggggcagaaaaggggtggttttcctttactaatttaatgggggcgtgggggcaacacaggcaccagaatatagcaccgggatgtgcaccggaaaaggcccgggggtaattagtacccgagggggagaggggccgtcattgtaatcgcacaacgtttcagattagcaagcagaaagtaaaaatggcaccaaagtctgtaaagggagccctttcctccttgccccctactccttcacgttcttcctcttcttggccagtttccacccttcacctgaacccttagtgcaggaggagacgtcctaaggaagggcgaaaagggacagcatcgttttatttttaaatcttacttctcactggcaatatggtgatgcttccaacgtttagttacgaactagttcgtataaaaaattctgggccagcactgtggtgggaggcgggctctgcagtaggcccatcactcagaggtaagtcggaacgcaggtcgcttaactagagaggctttgagttccgcttttcctgttctggaatcttgctaacaaaggcctcatatttgcatttttcccttaaagacattttaattgggaaatactacttaaaattcttggaagttaaattagatttaggtgtgtgttctatcacttaccacatccgtgttgtaatttatctgattggagttttacatttagtctccctgtggtagacttccaattatttctccaaatcatgtaatgttagccaagggtcagctgtttctgatgataaaaagatacagaaacatgaaagacgaatgtgattggttcctttttattattttaatgtgcactagctcgttttatctaacacttgaagaggatagatttttttaagtcccaaaaagaaaattagcagaagctatagcactatgtatagatttttttttcatgctttgtagttaccacagtctcaggaacagaatttttgaaattcatttgtgatgcagttctaagaagtgtataaaatattacagaaatatcttggcctttgcgagtttaaaatacacttattatttcaaaactgccaatttcctaattctaaacagtgtttaaagaaaatcgtttactcgggttttctacatctttttatcaatataaagggcatgctactacacacaaaaaaagtacatgcgaaggtgaaagtatctaaaatatttcaatatctattacagagtaaaagcaaacagtaaaaacatgttgctcttttggcacttggcaccaaatatgaaatttttgtgtccctagtaattaaacttgggaggatagagggctaatgcaattagaactaattgaaatactaagtgagaatattatgttgctaaagtatccatttcttttaatcatatgaattctgagtatatactgaactaatgcttccccccaaatccatgatacatggatgatatgtacatggtatgatacagccatggttttcagaatgattaaaatttatcataacacaagttggagaacctaaggactatctaaccattactaaaccccatgtggtaaactgccatatttttgttttgttgtgacagtgtgttaggactacaaggagaattttaaaagcaaagacagttatcgttgaacctcaataaacctcaatcttggcagttgttctgtgcagatataagtaatgaaaatagtgactctgtgtatgtgtgtgtgtgtgtgtgtgtgtgtgtataagtatcattgctcagatgaaattaggatatttaatgttttgggaggggactttttaagaatataaactagatcacaaaagaagaaaatagtactaaaaatgccacatttaataccaaactatattaaactatttgtttaaaatgtctcatttcaaaaaaagacattatttaaaactgaaaaataagtgttgcatttataattcttaaatttgtatataaatctttgaactgattaagttgagctatcttacatgtgtttttctgattcaaatttatcagattgtgcaaacatcatctacagaactgaagagggatatgacaatgaataaaagtgatatttttaaattagaagagccaggtgcagtcactcatgcctgtaatccagtgctttgagagaccaaggcaggagaatcacttaagcccaggagttggaggctgtagtgagctgtaatgattgtgccaccgcactcaagcctgggcaacagagcaaaaccctgcctctaaaaaataaataaaatgagaaggaaaccccatgcataatatgaggaaagctcaagagagctttatatttacaaaaatataaaatatataaatagcaaaagaacccaacaatatgtaggaaaagtaaaccaaccaataacaattgaaatagttcctaaagaactattgctactacatagaaagagatttatgaatgaattctaaaagattccaaggactagacaattcttgtatatcaagtgtgtatcaaggaccatgctatacaacctcttccagatcacaaaggtgacaagttatccaattatttgtggattgttgtaatcccaaaaatcatttataatttaaaaaaacactctttcttttgaagatggatttgactatcttaattggatccctggcaggtagaattcaaataggtgaatggaaaacaaataggttacttaacctgtgcctcaattcccttacctgtaaattggggattataatgataactgcctcacaggattgctgtggggtttaaacatgttaatctttgtaaaatagttagaacagtgtatgtgtacatcctatattggtaatacagacaaacatacaatttagaaatgtaactgttatagctcaccaagaaaaaataacattcattggtataggccaggtcagttgtagatgataatttatatacatgtatcagaataaagtagtgactgggatcttttcctgaccctttggggttactaattagtccaggaattatggtgaaatagtacactcttaacaaatatataccaaatttttgggagccaagttcatagaaaccttcattctaggctgtgatttcctacccagtgctaccaaaataaaggaaggaaaattagggagaggtagctaggtggtatggcgaggccaagacaaggacaccttatctcaagtccctgattcctgggaggtacagaaaatgaatctcacctgtacctttgactccagagttgggttgcaataaccaataagaaagaaggtatgatatggaccactgaagcagtccttgggataggaagtgggtgtgggagggatagaattctgccaacagatgaagtcttccaaaggaccatcaatgttttcaggaactgcttaggactgacatctttgtcaatggaacttattatggtaaccacctggtcatcctgagcgtatgaaaagagacaagatcatttacttgtttgggacagcaacctggacagtgcataagaagacaaattcttccctccctgcctgctttttcagacactggaacagtaaatagaaggttggaagtgtggattcaagaaagcagatcatgccttcacacacaaacccacacacagcctcctacctgacctgccctggtggggaagaggactgttgaaagctgaaaatgttcaaaatgttggggaattggattgagatgtactcagtggaaaaggggattttcaacagtgtacagctggcagtgttattgggggagaaaaaactttgagtatatacttccaatgatttgagacttctcactaaaccagttacctattttatgttgagtagttagtaatacctccattttacagatggggaaaaaagaccaaagagaagttagggaaggtcacacaggaagtaaagagctagaattcaaatctgatccatgtgactccaaagcccatgccttttccgccatgctcttcaacatgctgtgaaataaaaattagaagatttcttttcagatgccatatgagaaggaaatacctaactataggatttctgtatagtgttagggttcagctaagactggaaaccatgtgacattaatctgcggtggtatatggttttctttagctgtagccagcagtttgagtgtaggaagaaagaaggcagatagataaacagggttttgcagtgtgggcactcaaacaggaaaaaggggcaaagaatgtaaggatattggcagaagaatagatgaagtgatgggaaactgggtgtagcctatctggaaaaagcagttaaatcaaggcaaagctgaaatgtggagagaaggtcatgggaataaaggagtggaacttttacaattgaaaagcaaatataatgagagtaagggagtaaaagttggaaagatacgatgttagggtgggagaggaggatgctgaagtttgagactgcagagatgagacagtggaggaattgatctgtgaggtgaccttggagtgtgtctctctgatctcccttcaagaaagaccttgatattcagccatgaggaatgtagttggctgacagcctccaacttttagtgcctgtaggacctgcctcagcctttttatttaattttattttttattgatacataatagatgtacatattttgggcatatatgtgataatttaatacattcatataatttgtaaagatcaaatcagtgttattgggatgtccatcatcttaaaaattttctttatgctagaaacattcaaattattttcttctagctattttaaaatataacaatagattattgtaaaccacagtcgccctactccatgcttttcccagatatccccagccagtgacaaagctcagccgagatacttgggcctggccattctttgcaatgcagagcccttctaatcatcagtccttgttctctagcttgctgttgagttgactgggaacttgtcagatgtgcattgtggtctgagcctttcctttccagtcctgcttcctgtgcctttcatctttcacaggtgttaccttccaataagcctcttacacccctagttccattttagcatccgctttccagaaaagccaactgacacattctgtgaggaagatgaagattgggggttttgttttaaaaaggaaaacaggaggtctacacagcatgatgaaaatgtttcccagagaggacagtatactgaggatgagttaccaggaaggcagcatgtagcagcatagactgagactatacaggagtataaatgagtaaatgtcttaagttctgaacagcagagaaaggcagaattgagagaactgggcctggcacagtggctcacgcctgtaacctcagcactttgggaggctgaggctggcagaacacttgaagtcaggagttccagatcagcatggccaacatggtgaaaccccctctctactaaaaaaatacaaaaattagctgggcatggtggcacatgcctgtagtctctgctactctggaggctgaggcatgagaactgcttgaacccaggaggcagaggttgcagccaagatcacaccactgcactccagcctgagcgacagagtgagactgtctccaaaacagaaagacagacacgacagtttcaagttggactcagaataccacttgggcacatggaactctggaggagaaggtcctcaatgcttctgactggactgggccagggagctactgccccccaattaaaaaagtttgccactattcagagtacttccaggagcaaattacaaacttgtgaaacttactgagttaactgatgtcaataggattttaattcattaattaagaataattagttacaacttcactactcaaataattttaaatcattaagacagttttcatagtagcttccttacttctgggtactagaagagaattcaattcaatatactctgttcccgttggtaaggtttttttattccaaagaattttcagcgtattgcttacccagtggaagaatgtagggatctctggaactgtaaatagagttaacatcacttaaacaatccctagaggaatctgagctaatttaaggagtggacctttttgctaagatttcagtggaggtctggaattttaacaagttattataataaactcagaaaaacagacaagtctaactacaattttcaggtttatgggagaactaatttctttatggctttttttctggtcataaaaataatacatataaaaaacaaaaagatgatttagagatattattattcatctggcaattatttgttgagtaccaaagtaggggagaaaaactaaaaccagacacaagtgtgaaggatcggttacttcactataacatttcaagctttttaattttctattgtgtaaccagtataaaatagctatatgggaaggcttctttgttcttttgtttttaacacaatagagttactttgtcctgccgtccttataatctctcatgtatgggtcactcttaattattttattttgttcaacagtatcctgattgcagaagtctcttagcctgacataaattcaagctgtaaaatctagaacctgtatttttaaaaataaataaacttttaaaagaccactttaaaatggaatacaataattacgaaattatgattgtaaatatatgttaaatataaaagtggaaaaagcaacatttaaatcagtatatttaataagtgttataagtaaattaataaatattttaagttgacatttaactattttgcttatatctcaaaagtttaacacatcaggttgtcccaaacacacttttgaaaatgtgctttagaaaaacgggaaaatcatattatatttggacatatctagaccaaattaaaattggtcttttttcctctactttgcggcataaacaaggtatttcttaaacagccctaatattttgtagtgttattttgggggaatctatttttaacatactacctaaaactgaactcagaaaaaaatcttacagactttttttacaagcaagacttaaaagtttttaaaaccctagtagaataaccaatctctactttcattatagtaattgacactagttttttaatgttctatgcaccttgaatcaccagttactacaatgaaaacacaaagagccacctgaatatcaaatacatgcattattacaagtgctcacacggaatatgagatgaattactgatgaacaaagcatctaaaatcaacttatactcctcatgcatatgctgtggatgatgacaaaagaaattatgaaaagatatatatatgatatacatgaatctatattctctaattgagacattatacaaatctttataatagactttatattaattaattaggtacttttttccattacagtaatctcctaatgaagttatggagcaaacttcagctttagcaaagttgggcaagttatttatactgcgaaagatagctgaaggataactgttttcaactgagaccaaaagacatagtagttagcatttattttcataatcttaaaaaggcatacaatttcggtaggaggcagtagttatagtgacactaagggagatggtagattgggagcattcaatcagcattcggggagaatagagagaaaaggcaatatcaagagaattcgtcaccacagttgtctggatgctgttgccttctttgctcacccttgaaggtcagtctggttctggcccaggcccaagatctaagtttcagatcacggcaggcttaggagaacagtgcagactggaacatctaatcccaccccagcttgccctaagatggcccctgaatttgttcagctcctgggcctgccgccgtcctaacttgcctgaaactgttttccaaaaaattagagcatagatgagcaatgccacgttagcttcagttttgattttgggtgttaccacataatttttttaaaagaatttttatcttcccacataccaacttttagaacagatggcttaaaatgtcttagaggaaattagttgtaatcagcagatgagagtgtgtctccttgttttcgtggcagaggtagctatcaccccttaagtacctatctgctacatgtgaactggcaccaggcattgtagtttttctgttgcattttcatccagagggttatgatgggcttcgttaaaatgatttggtacacatgtgggcatttgcctgcaagtataacctctgtgaagaggtaaactgtataggcttcaaggtggctttctgctgaggtggctgccagcctccctggagaaggtgtcagctgaagacctcaagtaagagccacagtgaagctcatatgccttgatctcttttctgatcctggcaaaaggccagctgtggagtactgctgcagtcaggagctgggggagttggcagattgccagataaggggccatactgtcatttataaggcaatggcttttatagatctctagtaacccatactcctacttacttgaacactatgatttctgggagaaaaaagagccagataactttcccattggaataaaaccaaaacaaacactgtatttaggttcacaggatctatattgaatgtcttttcaaagtacttcatacttatttcagtcaatatcctttgcctgatcctgtgtccacaacacacatgcctcctgagtcttaagatgctccttgctcctctagacacctttgaagatactctcattccactacgcctggggccatgtaatgtctgtaattgcctcattaactctcaccttgagttctctgaatctggttttctcaaacatatttgaggataaggagactgtcacttaatgtgaaaggtgtcagaattttctttttttcttttttttttctttttttgagacggagtctcgcactgtcgcctggactggagtacaatggcatgatctcggctcactgcaatctcggcctcctgggttcaggcaattctcctgcctcagcctccccagtagctgggattacaggcacccgccaccacgcccaggtaattttttgtatttttagtagagatagggtttcactgtgttggccaggctggtctcaaactcctgacctcattatctgcccacctcagcctcccaaagtgctgggattacaggtgtgagccaccgcgcccagccaaggtgtcagaattttcaaaggaaaaatggaatattgataaactgagtaaaatatgattaccatataatgtcatcttaagatgttcttgtagtttcaaacttgtataaacaaaattggtatttatacatgtgtcctattaatgcacacgagagtagattagaacctatatccagagtattttttcttgtgccttgaaaaaccaacttaaaaataaggtatttcaaaatttggtttctaaatacgtttcaataaggtttgttattattctttttcttttaaaattacatttttataaataataaaattttaattgtgctccagttaactattaataaatattcagaatccttaagggtttattttagttaaaatgtttaggactaatgcattagtaaattgaaatttggatacaggaattgcctggatctttgttttacaaaaaaaatcagaaaaaagtaataccaaccctataaaatcctaaatctctaataatgtaaatatattattagtggtaatgttatttgttgagtttaagagtatatttaattttatagaacaataaaatattttgatatagaatattcagggaaaaaatagagaaggaagacaattgtaagtcggagagaaactgggatctgtctataatgactgtgttaaagaatagcactaaagccacctcataaaccaatgacgttgtatcacgaaatgacttttaagttgatggagctgcagcaaataagttcaaagcaagaggtgccagcaccagagacttgggttttgatacagctctgctccctactggcttatcattgggatcaaataggatcattgcagtactatctcataaagccattgtgaggaataaataggatcatgttggaaaagtgcttcacaagttttaggtaatctaatcttgctaagaaaaggggcgaataattcacaagaaaaaccagagtaatgataaaaggtattattgcatgctaagtgagcactgtgccaagaatttcacatgcagcttcccatttcatcttcataacaacatgataaagaatagtatgaattggccgggtgcggtggctcactcctgtaatcccaacaccttgggaggccaaggtgggcagatcacttgaggtcaggagttcgagaccagcctggccaacatggtgaaactccgtctctactgaaaatacaaaaattagctgggtgtggaggcgcatggctgtaatcccagatactcgggaggctgaggcaggagaatcgcttgaacccaggaggcggaggttgcaatgagccgagatcgcgccactgcattccaggctgggtgacatgagggaaaccgcatctcaaaagaaaaaaaaaaaaaagaatagtatgagttattattatctccatttcatagatgaggcaaatgagtcatagagaggtgccaggagacatagttaattagtggcagagtaggaattcaaagacagttccacctgactctagaatctgagcactttaatattagctatagtatattaaaaagttcaacttcattagtaagtaaagatttaacaattaaaacatatggacatgggagtgcaaaggaatgataaacatcaaattccagttgtctctgtagagggagggaggaaggcattggaatggatttgggaaagtggtgcatgacgatttcagttatatatgtagtattgactctcatgtattcatcctgatatagtggaaagagcataagtattgagttagtcaagccaggcttttaatgaaaatgtggaaatttgttaagacttgacaaaccagaaccaggggttatatattttttctgcatacttttttgaatgcttaaaataattttcatggtaaaaaaaaaaagcagtgaactaaagtcatcctacttcatttatacaaagattaaataattaagaaaataattttggtgaaggtttggagaaaccgatatacacttctaatagtataaatgggaccaactcttttggaaagcaacttggcaatatgtgccataaaaacaatctggctctttggttcagtaagtttccttttgggacattatcctaagggaaaaaaatcaaaatgtacatgtgcatacagaaacatacacactggaaaaactgtatgcatgaaaatgtcaactgcagtgttgtttataacgatggaatatgataaacaatctaaaattttaacaatagaaaagtagtcaatattttgcagcctttaaagaaatatttatgatggctatgtagcaatttgagtaatgattgtgatgtaatgttaattgaaaaaaggatatgaagttgcatatccaccaggattaaatcaatgaaaaaataatcatagaaaaagatttaggaagaaacagcctaaagtaatgagtacagaatttgtgtcaaaatgatgagatgcattctttcctttttctcttccagatttttgatatagatttgacatattgtttttgaaatggaaaactacagttgtccattggtacccaagagggattggttccaggatccccaaagataccaaaatttgaggatgctcaagtctcttatatagaagggcatagtatttgcatataacctgtgcacatcctccagtatatttaaataatgtccagggtacttacaatacctaacacaatgtaagtgctatgtaaatagctgttatgttgttttttttattgttgtactattattttttattcttgggaagtttttcctttttttttttttttctgagacagaatcttgctttgtcacccaggctggagtgttgaccttctgggctcaagtgatcctcctgcctcagcctcccgaatagctgagattacaggaacgcaccactatgcctgcctaatttttgcattttttgtagagattaggtcttgccatgttgcccaggctggtctcaaacgcctgagctcaagcagtcctcccacctcagcctcccaaagtcctgagatcatggtataagccactgcacctggcctttttccaaacagttataatcagccactggttgaattcacagttggttgaattcatggttggttgaatctgcagatgtgaaaccaatggatactaatagccacctatattacatagtacaaacctagctttgaaaatagtgagacagatatgaaaataaactagaattcacgggagaaaatgaggggttctaagaaaggtgtagacaatacattaccaatacaggaggtcagaggaaggggagatctgtcaggctggggtcttcaggaatgcttcacgaaggagggactatcagtggacttcagtaatttgtagagccgggtaagagctggggatgaaaggagggctaagcaggaggcatgcaagttgcaaagtggagcaatgggagatgttctcaggaaacagcactgtgtgtcacggaatattttactttcagtttttctgggttttcagaaaatgtggtaactttaaagttttcacagttgaattaattccacagaacaactggttgtagaatcatagcaacataattatgagttgtgcttctggctccaaatctttcatctaaaaataatcgcagtgaccacatcttgggaaaacaaagccattacctattcttgtgctccagctatctcggtagtcacttactggaaaatggattacaggtaaaataactgcatgtttttaggacactacttgtctctcttaccttcagtgagttgattaacgaaataatttaaaaacttatattctccaggcattctctaaggcatgaacatgattttgaagaaatcctttaccatcacacatcacacaagcctgcctgtgctcctccagaaacgtagccctagtactcctggaagcccattttgttccttcagggagtatgctttctttgtgcagagaggagaaaaatgctggagacagagatgtggggagtaagaggagggacggtaggtaagtctcagccacaggtaagatgagtgggaacctgtatgctccactgcccccatgtgtaccagctgttctttgcccagcttccttgggctagaaacatattcagtgagtaatacatgaatcaacaagatgataggtgtgtcatttatcaaatgattacttgtgctagaagtttacaaccattcaattttatttattttattttattttattattttattttattttagatagggttttgctggatgcgcaggctggattgcagtggctcaatctcagttcactgcagcctcaacttcccaggctcagatgattctcctacctcagcctcccaagtagctgggactacaggtgtgtgccaccacgcctggctactttttgtgttttttatagagatggggttttgccacgttgcccacgctggtctcaaatgcctgggctcaagcaatcctccctcctaggcctcccaaagtgctggaattacaggtgtgagccattgcgccgggccacatcccttaactttaatgatcataagaatcctgcccagcttataattcaaatgccagggtactcaggttcttcaacagactctagttttcttatcctctaagattagtgtaaaataaaagtgcctgattgccatctcacacactggtgagaaattctctgttcctctccacatctccaggtttcccttccttgcctcacattctgttttcctacacaggccaaattctccatgtctcctttacatccccctggtgtttgtgttcccttttgctatatagccttgccgaatacttggcgcatcaccccaatttcttcactccccaaagttatcacccacatatgattgcttggttaacaaacatttatttaacttttggtaaaaggtaaggaatgttccactctggtgccaagtaacaacttaatattggatattaaaactgtatccccaaatagagccccagattcctggctactttgctggacttctctctttcctagggttggtgctttcatctcaaactccaggatgctcaaaattattgttttattatgcaaagcattttagttctctgcctggggcttcctccttcatatccaaagcggacctatacaggtgttttcctaaacttaagagtcctagaaatcagaaagctatagtctgctacaattttaaatagcatttacacaagatgaaaaaacaagtttagtgaaattaaatgactgcccccaaaaaagggtcagagcctgaattaaaagcctggcttgactaactcaatacttatgctctttccactataccaggatgaatacatgagagtcaatacctattgaatgtttacaacatgtctggctctgttctaagagcttcaggggcattagctcattcaatcctcacattagttaataccccactttatagaaacagagataactacccatagtggcagctaacacatggaaaggtcaggattagagcccaggtagtcagtgtctgtgcttctcatcattaactgctactctctaccagcctcaagatccagctccctgacattctttcagtggctgaaaataagggcagcttattatcacatttgggattaagttaaaaaaaaaaaaggaaacaggggcagctactgtgtgagagttcagtctgctccctgaaaatgaccccagcatggtttggaaactcaaaatttctaaaaaccctgagagtacatgggcattgttggggtctgaaggtatagactagatttgctcagtgacaaacttaattataaactttataatggctgctttcaaaaccaatcaggtaattcagtcttttcttgcttaattagttgccacaaattcactcaatccatttagtcagtcagtcattcaagacttattgagtgtcctctatatgtcaggtactgttaggcaccaagtgaagaaagagggatccttcgggtccagactcagtcctggagtggctccaaatgttagaattatgattagtgtttcttcctatactatacgggatggtgctgagattctagatttcgtggcccagttctttagagaaaaaaattactaacatgaagaagggcattaaattgggtcaccattgcttgagggaactattccttaagaatatagaacttgctttgattttttttacactctaagtgctgctctaaggtttgatttcctgagtggacaagactatcaaggcaagaagtcccatgtaggtgacaactagcaatatttgggcagaaacatatctcactttaataaatgggcatcttaatgtaaagctggatcttagacatgaactaaatcagtggttttcaaactgtgctcctagggcctcatttgcaataaatgaacattttaaactgcatgtgaaaactgcattttttggatatctgatttatatattggagttttgcaatttaatttcatttaggaagaagaaaaaagagcccttttgcaaaatgtgaacacctctgagattttcattcatttctctattcacaagggactaaggcctagagagatgaaatgactcactgaaatggcagagataaatcgtaaacctaggtcattactcccagcccagtccaatgcacagatctccccctttctatctactacccactgtgtgtctggagagcatggcacacaggccagtgtaaatctgggtgaactatgtctttgtagtactgcaaaagctgagaattcagttccaaatggttctgcaaaaatactgactgaggactatttactgtatatatgattaagtgctacataatctactatgttcctcataataatccatgagttgggctgagcaaatatctccccagccctctcctcaattttgcaaaaagcaaaacagtctcaaagccgttgacttctttaaagaaatgtattagtagataacaacaacaaaacaatccaaaattccaatcttctgacttttaggaagacagagctctaaccattatattatatactgttcaagccaactggtaagaatatgcagtgcttgtgcaggcaggagagcaatgatgtaattaaataggacagctcccaaagttgacaggcataaatgatgaaaggcaaagtttagatatcaacctatgagccatggacacctgcagagttttaaaattattacaaagggacctgaagtcccataaggtatgcttacctgaataaggtgggttgcactgatatatacacccagacttcaaatggatagagatgctcttttgtttaataaagtatgccttcaattaaaagcattactgaagccagatgtggtactgtgtgcctacagtccccactacttgctactcggaaggctgaggtgggaggatcacttgagcccaggggttcaagtccagcctgggcaaaaagcattactgaattcctagcaatgtgtttatccttatgtactttcagtcaacttttactaaaagtacaaacactattatgtgcaactctgtgaaattttgttgttaaaaatgaaatcatagttgaaaatgtggggactgtctgttcaaggctaaaataaagggaacagaacaaaattaagatgggaaataattattttaaaacatattttgtatgttttcctgtgtttctattttaaagctatatatctaaattattgctctttgttttcatgttgaatggctgcttcttatctggctttgtttattaagtgtggtcagatcatttattctcagaaaagctaccctgtagcctggccctacattcctccaagataatatcatctgcaggactcaagtttcttgccagagagctgatttgcagaagtaaacaaactgggagtaaaaccaagaaatgttaaagaaactttctgacttaagacattgataacaaaaactatgttagcaataagtgtctctaaaaatatatagaatatccagtcaagctgacctacagaattggaacagtaaacagaacacaaaaagggctgtaagcaataccatctaggaacacagaggtaacagatagggctccatgtctgtcagggactccaggaggaacagctgttcccttctctcaaaacaaaccatcctctgatgcgtttcagttgcttaccaactcagatctgcttttgaggagtaagccaaacacacagcctctggtgatttaccttatagagggcattagggaaacttaaaaaacaaatgtcaacttgaaaaggccacattttatatctttccttcatctctggcagtattccgttgttgttccaactacccacccccttgcccttccttacatttgattctttgttagatgaagcatggagacaatggaaagcaactgggaaacaaactaaacatttccttctggaaatattacctacttttaaataaccactagggtctataaatattttcattagaaatttgccctccctccacacacaccagtcactttgtgaaaaaccaatttctccaagtcagaacctagaatttatggtctcctctcattgcactactaaaacctttcatatccacagtgaatctaggctattacctctggagactggagttcagggcctcactcatatatttatctcatgaactaaacccctgtaattccctgtggagttggggtttggaggcagatgatagagaggaaagttagagttacaaccatttggttcaatgtggtagagcgctgaattgactgtgtgatcttaggcaagtcccataagctctctgggccccagataactcatgtgtaagaggaaaggatcatactagatgacctccaactttgtatcttcgaggtactgaatgggaaccaaagagtaaagggaagtcgcaaatagaattatggatgtggtaactgaattattcccaattcttccctctctccctgcgatagaattacaaagcatttgtcaagtggcttggcagtaccttctatcagaacgggcagaatatatgtagcatttccccacctacttcatatggggcttgcccgtgtgacttgctttgactgaagttagtagatgtgatgcaagcagaggcttttttttttttttaacttttattttaggttcaggggtacgagtgcaggtttgttatatagataaactgcatgtcatgggggtttggagtaaggattattttgtcatccaggtagtaggcatagtacctgatagatagtttttcgatcctcacccttcttccaccctccaccctcaagtaggccctggtgtctgttttctcttctttgtgtttccttttgttgttgttgttgttgttcccttctttgtggccacgtgtactccatgtttagctcccacttataagtgagaacatgtggtatttggttttctgttcctgtattagtttgcttcattgtcgcactaagcagaggctttaaaagtggctttatttcttttgcttctgtaatctcctggctagccactggttcaagaatgaggaaaggggatgttaaactgaccaaaaccttgaacaagaaaaatagacagttttgttttaagcttctaaaatttgtgtttggttatgtggtactattgcagcagaaacacaaaaatctctgctgaacttttttcatatattctatccaacaatatgcctactgaccttaaaattttattgagctgttgaactaaactgaaatcatctaggcatcttagcttgaccatggaaatgttctcctgattagcaccatcagcaggacgacttttggtgctgaggatactgcaaaactagaaattagtgtactgaacttttttatgtaaaaaaaaaaaaacactgtgtttttagctatattgagaaacgattcctgtgaaattgtactgtgttggctgtaaggatggtggtcactgtaacttacagtgtagtctttgtggcaaacttttggagaaattgctctctggtttcagcaactggagaaactatgttatcgtaagcaattggtttgtttgaatcttatggacagtggatctctatctggttgtgagccctcttgaattgcctggaaaattcagagccaaatatgtggccctacataagcaagtggatgtaagtgactttgcagcatacgttttgtttagcaacttcccctccttgtattattttcttttttctacacttattttctctttttctgcattccttgtaaattgttatcgttattatgttaagtattaagtattattttatcatatacatttatgtcagccaccttaaatccttttgggagcagaactgagaatacataaagcactactgttaataaaaaaaattaatttccgttagtaaaatgaagagagaaataaaattttatcagtgacccctcaacccttttgttgttgaaacttactaaggatctggcgtttctctattctgaaatatctccaggtcagtgttgtgaataaagcactgatatacattggtaccatttcgaattcatcatcaaaataaatgtaaagacaagctgggcatggtggttcatgtttataattccagcactttgggaggctgaggagggtggatcacttgaggtcaggagttcgacaccagcctggccaacatggtgaaaccccgtctctactaaaaatacaaaaatcagttaggcatggtggcctgtgcttgtgatcccagctgcttgggaggctgaagcacgataattgcttgaacacagaggtggatgttgcagtgagctgagatggtgccactgaactccagcctgggcgaaagagcgagactctatcccccaaaaataaataaaaggacaaaaattgtctttcttcaagctgtttgaaatagggaggaaggtttttctttacaaataatttgacgtattattctctttttttgttttgtttttgttttgagacagggtttcatctgttgcccaggttgtagtgcagtggtgcgatctcagctcactgcaacctctccttcctgggctcaagcgattctcctgcctcagcctcctgagtagctgtgattacaggtgcatgccaccaggcctagctaattttcatattttttagtagagatggggttttgccacgttggccaggcaagtctcgaactcctggcctcaagtgatctgcccaccttggcctcccaaaatgctgggattgcaggcgtgagccactgcgccaggcttgatatattatattattcttttaattattaaagttaattttttttaatatttgttgaatattgactatgtactcagatggtgctagctgttatggacgatataaagatattaataaataagatacttgaatctttaagatgccccatggccagccattgtggctcacatctgtaatcccagcactctgggaggctgagacaggtggatcactgagcccagcagttcgagaccagcctgggcaacatggtgagacttcatttctacaaaaaatgcaaaacttagctgggcatggtggcacacacctgtaatctcagctactcaggaagctgagacaggagaatcacttgagcctgggaagcagaggttgcagtgagctgagatcgtgtctctgcactccaacctgggcaacaaagtgagatcctgtctcagaagaagaaagaagaaagaagaaggaggaggaaggaggaggaaggagaaggaggaggaagaggaggaggaggaagaggaggaggaagaagaagaagaaaagagaagacaatgacaacgaagaagaagagaaagaagaggaggagggaggaggaggaggagctcccatgtgtctacattacaaagacaacttggtttccttgggtgtaattgaggttcactgcaagaatgatgaagaaagatgagggaggcaatgtggaaggactagcaacctgcaacagaagcatgatctggcctcctggttctagtgcagtgctctaatacatcaagagattagttgccaaggttgggggcaggacaagtataggaaacaccagcataaacacaaaataagagttaaagatgaggaaaatagaaacttgaactagtcagggtcactagataaaagcaaagaataatcaatagaaacagagccaaatcagaagctgaaagaatggttctgattcaagatattcatctgagtttacatgttttaactaccattgaatatccaaagggatatgaaaatatgaattggcacttgctgtgaaatttagaagatttccagtaaagtgttctatgtttacaggcaaatgtgccatatagggaagtcagagaggggcaaataccagtcccaccagcaactgtagaaagtccagtaaagatagagtctacacaaggcaatatctcatggcatcccagcttgcccttcatatagacagcgtactgagtagtatctcagaaaccagtgagaaattctttggcacaatggtgaggtctgtgggccctaccacctctgccctactcccacagacacttggaatgccgatttattaaagtaactctggtaaatcttgaaatttcctttctcccattgactgtatctaatatttcaacaggacccccaaacaattctgaaattaactgtgaactccacccatggacataaacacaatcatcagaataaacaaaccaatgaaccatcttctagattaaaagacttagttgtaatgtaaaaaaggaaattaaccagaggaataaacttaaatgaccccactcgtgaaagagttaataataaaaccaaaacaaaataaaacaaaaatctttagaaaaatctctaaatcttaaaaaatctagaaagatgctgagttaccaacaagattcaaaagaacattacaccatatgcacaccatatgcaaaatttaacactaaattgatcataggcctaattgtaagagctaaaactataaaattcttactagagaacaggggcataaatatttttgaccttggaaaaggcagtggtttcttagatatgacaccaaaaacacggataacaatagaaacaaagagattgtacttaaataaattgtacttcataaaaattatgaatatttgtgcttcaaagaaaacctcaagaaagtgaagagaaaaccagtgggctgggcatggtggctcacgcctgtaatcccagcactttgggaggccaaggcgggtggatcacaagatcaggagttcgagaccagcctggccaacatggtgaaacactgtctctactaaaaataaaaaaattagctgggcatggtgacaggtgcctgtaatcccagctacttgggaggctgaagcaggagaattgcttgaacccaggaggtggacattgtagtgagccgagattgcgccactgtactccagcctgggcggcagggtaagactccatctcaaaaaaaaaaaaaagagagaaaaccaacagaatgagagaaaatatttgcaaatcaaataactgataagggatttgtatccaggacttttacaactcaacaacaaaaagacaatctgattttaaagctatctgaatagacattgctccaaagaagatatacgcatgaccataaagcaagtgaaatgatgctcaacattattagttattagagaaatgcaaatcataaccataatgagacaccatgtcacatcctgtagaaaggctatcatttttaaaaaagacataaaaggcattgacgaggatgtggagaaattggaatcctcatacactgctggtggaaatgtaaaatgatgcagctactttggaaaaacaatttggcagttcctcagaaagttaaacacagacttaccatatgacttagcaattctactcccaggtatttacccaagagaaataacatgtttacacaataacctatatacaaacattcataccaacattattcataatagcccaaaaatagaaataactcaaatgtctgtcaactcataaatggataaacaaagtgttacacacacacccacacatgcactcacatacaagggcatattattcagcaataaaaatggagtgctgttacatgctacaacatggatgaactttgaaaacattatactaagtgaaagaatcccgacacaaaaaccacatattttatgattccacataaaatatatacactttatattatatatattgtctatatatataggcaaattcatagaaacagtagattagtgattgccaggggttgagggagggggcaatagggagtgattgctaatgactatggggtttcctttgtggatgatgaaaatgttctgaaattagataatgttgatggttgcacaactccaaaaaggtacaaccattaaaaaccgctagactgtgcactttaaaagtgtaaattttatggtatcttaaaaaactatcaatcatttaaaaattacattttaaaataggaacaatttaagattagaaaagattccttttgaaataaaaataagattgctagaattaaaaaaaaaaaatgacatggaagctgggcacagtggctaacccttgtaaacccagtgctttgggaggctgaagtgggaggactgcttgagaccagaattcaaaatcggcctggacaacatagcgagaccccaaggcaacccagtaagaccctgtctctaaaagaaaaaaatgaaatggaagcagtaaagagcaaaattggaaagtgacaaaaatcaaatcagtgaatttgaagaattcagagaaaagtgataaaggagtgaataaaatgagagaaaagatgatgtattaatggaagacgatgatggatctagaatatctgataaaagatttcaaagagaatgaacaataataaaagagataattatttctaatttcccaaagaagatcaagccaagttaagatccaatcaggtgaagagttgttttttgattgtattgtattactattgttattgtcgttattactattttttttactattattagtcagcttgaaatgtctatttttaactgacaaataataattgtatatatttatgggcacattatcatgttttgatctatgtatacatggtggaatgattaaatcaaagtaattagtaaagccatcacctcacctacttaacattcttctatggtgagaacatttaaaatctacttagattactgaaatttattcctcctatctaactgaaactatgtaccctttgaccaacatctctccttttcccaaccctaccctcatcccctctctagccgttggtaagcaccgttccactttctgcttccattagtttaactttttttagattccacattatcattgacttcatgcaatatttgtctttctgtgcctggcttattttacttagcataatgtcctccaggtataaacctgcatattgttgcaatgacagaatttccttctttcttaaggctgtatggtattccatcatgcttatataccacattttcattattcattcacccactgacacttcagttacttccgtatctttactattgtgaatagtgctacaatgaacattgaagtgcagatatctctttgacatatagatttcaagtcctttggatatatacccaaaagtgggatggctggattatatgatgattctgtttttagttttttcataagcctccatattattttccataatggtaatgctaatttacattctcatcaacagtgtaccagggtttccttttctctacgcccttgtcaacccttgttatcttttgtctttttttaaatgatagccattctaaccggtgtaagacgatatctcattgtgttttgaatttgcattttcctaacgattagagatactgagcattttttttcatttctctgttgacgatatgtatgtcttcttttgacaaatgcctgttagcttcaacttgttgcctagaaaattatggagtctacttcatgttgtattacagtagaacattaaggtatgatcctggaaatcagggtcccagctctgttacttatcactaatgtagctttgggcaaatcatttcacctctttgggactcaagttcctcatctgcttaaaaaaaatgaaaggaaaagcttgaactagatgactttaacacaattccttaatcaaaagatatgagccaggagacagatagaaagtaaggcaagaaagctagacagcagaagataataaggaagtccttatctaccagaactaaaattttgagggtgacgtgagaagggggcgagctgtacaagcagtcctgacactgtccgtagtcctgaagtgtcattattttgtctggctgccagttggaggagttgggaattgcttaggtaagcagtatggagatctgacaattttagcgcagaacagtgaaactgagctcattcacatctgtgtatttaactactacagattctgatgattcccaaccctatatctctagcattgaccttcatcctgatctcccaatacatgttttccactgtctaccaagtattaccagcatttttactgtattgaatttacttcaaactcaacaggtacaaaagtgaacttatcatattcattaatgatccttcttcttctcctgtattttctatcttgattagtgataccaagatgtatccctttccccaagccaaagaactaggagacttccatgattttaccatgcccaccacctatagtcaatcaccaagtgtgtcctgccaatattgcccataaatacatcttacattcatctctttctctctaccccactgtggatggatttatttaggttataaatgtttcttggttggactaccataacatcctcttcaataatcttgtcttcaattttgcacccttctaatttacatttatgatcaagctatttccctgctaaaagccttccctggctttagttgtttatagcacaaaatccaggttactcagaatggcattcaaggacacttcataatttgtacagggaagaaaattctgaaacaggatatttattagggagttcccaatggatcaacatctgtagaaaaatggagaaggaaacagaattaggtaaaaggagaagttgagctatgatccagccccaataaaggttgctcagcccacccgttgggtagctctggaactggactggctgctcagaattgttccaagttggatcaagtgggagccacggctttgtaaaacacactggtcatgcattggatgcaagatgtctttggaaggaagaaagacttgggtaatgctacaatttgagggttgtcttctggcatcattgtcagaaactgggagaataagtccttcattcccaaaggcagatctcagcagcacatcagaaaatccaccagccaccgtatatttgtctacctctacacatcctcctctgtacttccttgactctctgcatttactttatcataccatttactgaactctattttattgcctctttacttttctgtattcttcactagactgtgaactctgtgcaacaaatgctgctactatataaatcattgctttatcctcaatgcttgcagcattaaacaatttataaaataaaacattaagcactttgagaggctgaggctggcagatcatgaggtcaagagatcgagaccatcctggccaacatggcgaaaccccatctctactaaaaatacaaaaattttctgggcatggtggcaggtgcctgcagtcccagctacttgggaggctgagccaggagaatctcttgaacccgggaggtggaggttccagtgagcccagatcgtgctactgcactccagcctggcaacagagtgagactaagaaaatattaaatgaatgaatgcatatttcctttctccccactctttactccctgttgctctagtaaaaccaaactacttgaggtttcctgaattttccaagcctttctttgaggccatgctttgggtgtgctagaatgcctttgacttagtcatcagctgaatatctacttctctttcaaaagtcaattcaattgttacctttggaaaactttccccaggcacagtcacaatcttcattctctgtttcctgagaactcattttgtaccaactattatactcctattatttttaatttacatgtctgattattttcaggagatatgagaccttgagcctcatctattttgtgttcttagcacctaaagagacctggcacaagatgaagaaaaaaagaatgaacaataaatatgtgattaaaggttaggctctaggattactaaccaggaagtaatgtgcagaatgaactaaaaggaaaggagttatatgggagaaaattgttagtttatacaagaggcatgtgactgtggacactggatttgctataattccttattcctgaagttagttttttccacatgcaaattgaagagcagaatgatgatattagcatagttgtaactttgcctaacatgtcttagtcatgtagtgtcccagtctacttatgcaatgctagtgtaagggtgtcaaaatcaaatgccttcaggggccaggaagagtacctaaatgtctaaatgttcggtgggcctataggaaacaaagggcccacttgaggggcattcaatttcagtttttaaataatgtggtcaccaaacagaacaagtgtttgggcctgacatggcctgcaaaccaccagtttgcctcctcctcttttacacattttgaaatcacatttttttttaactacaatggaactgagtgggaggagatatgaatgacattttcatccttgcagaaaaagagggtgtttctatatttctaataaaaaagtagaattatttttgaagtggcttccttctctgccaggaagccaggaaatcagattagaaatttcattggcattaaaaaaaaaaaagatggcagggtacagtgtctcatgcctgtaatcctagcatttttggaggccaacgcaggagaatcacttgaggccaggaatttgagaccagcctgggcaacacagtgagacccccaccccagctccaaaaaaaaatttaaaagtattctgggcatggtggcatgagcctgtagtcccagctacttgggaggctgaggtgagaggatcacttgagcccaggaggacaaagttgcagtgagccctggtcataccactacactccagcctggggaaaaaaaaaaaaaaagaatctttccttggtgttgcttttttttttttttttttttttttgacaaagtttattttcttcttattaaaaaaaaaaatctgttaacatatttcaaaaatatagaaaagttcaaaaataatccctcaaaattccaaccagtgaacaaccttgactatcattttagtttatgcatcagatattaggtgggattgtaggactgacatgtgtactcagaactaggtggcaggtaagcaggaaagcaatttatttctaaccagctgggtttctgtaactaatgatctaacacagctaataaagacattctgggcagggcacagtggctcacgcctataatcccagctttttggaaggctgaggcaggctgatagcttcagcccaggagttggagaccggcctgggcaacatggcaaaaccctgcctctacaaaaatacaaaaattaactggtttggtggcacacacctgtgtgtcctctgctactccggaggctgaggttggggatcacttgagcccaggaggtcgaggctgcagtgagccaagatcatgcctctgcactccagcctgggcgacacagtgagaccttgtgtcaaaaaaaaaaagacactctgagatgactctaaagtgcctgactaaaaccagatagccacagggcctgacaacgaggaggagtttactgctgcgctactattgctgaaacggaacttggttttgaatccacaacagaactattgtgcgtgtgacatttgctttgagaaatgaatactgggttgacagtacacaagagcttttcagtctagtccataaagaactttcacttgattgccagctttttaccagtaattcaacatagaaaagtacagtttttgaccttaaaactttgaatgcaattcctaaaattaaaagatgtggatttatataagtcaaatgagaagacattacaataaacagagccacaggttttgtttgtttgttttttacaggaaattgtgttgtgtttacatttagagcattctgtgctgaggtattctctggctcatatatagaatcataagggagagaggagttgagaagtagttccctagaagaactagagagagagatgtaattatccctgatactaattagcagagatctggaatgaaaaaaacctcaataacctcatattcagacgattttttcaacatgttcattattaatagtaagcagacctcatgttaattttgaagaacacttaacagatttcaaaatatctgaagttcctctatttttttcctaatgaattttaaaatttttgtaatttttaaaaatagtattttggacttccctcgaaattttcctgcaatgtcactggtatatttggggatagagttttaagaatatccccagtgagggtttagaaaaatttaattcattataaatagatctattttaccttaattattattctattataattatttctttttttttttttttttttgagacagagtctcgctctgttgcccaggctggagtgcagtggcacaatctgcaacctccacctcctgggttcaagtgattctcctgcctcagcctcccgagtagctggaattacaggcatgccaccatgcttggctaatttttttgtatttttagtagagacggggtttcgccatgttgccaggctggtctcaaactcctgacctcaggtgatccacctgctgtggctgggtgggattacaggcgtgagcctgggattacagtgctgggattacaggcgtgagccaccgcacccagcctgttataattacttctaatcataatatttcttacttacaggccacctcatgttcagaccattttttccatatgtaattagaaatataaagcctgtattgcacttaaatatcattatactgttttaacatattttcatctacattaaaattcactttaaaattattagtcttagaaaaacaatcaaagaaaaataaagtatggtgtctccaaggttttggatattctaaaaggaagtagctgttctttcaagctaaatatcataaactgattttattaaataaggtcttacattttgtagtggcagcagtttataaatacaggcttactaattcattgctttcttttattcattagttatgttttggtactttatttaagtacccgagtggattatactagatgctgcgattcagaaacacaggctgtctacaggtgagacacaagtttcacctccaggggtacacagtttaattgcagcaaaatgttttaaagaaggaatgcttcactgtggaaaaaggaaacaagtggcttgttacccaaagagcacaaggaacccctccactgttgagttgttcacattttcttggtttatgcttcaggtagaggtaagtgaagcttcaaataatattatgccctaaagcttcaaactggaagaaaaaaaaaaagcccttgcacccctgaaatatgcatgcatgcctgagcatgcacacacacacacacacacacacacacacacacacacttttaccttgctctaaatttttgctcatgtacttagtaataaaatgttatttttagagttcacagccccaatatggaaatgtgtctagagcttggatctagaagtttatgtctttcttgaagttcctgggtcgtaataaccacagtgaggacaaaggcaccagaacaatgccaaaccaggagatatggcctgaattagaaggaagacaagtttttatcaggcataacaatgaaagaagttgaaaccatggagttattattaagagaagttgtggagtagttattcctggtagcctctaagtagcagttggtcctaaatcacaaaggtgtgtatttttctagagattccagacaagataattttgagggctcttatactatgattataaaaacctaataactatgttttaatgtagtgcattgtgtttttaccacttaagatggcagtgatttcatcagacagctttcttttggggagacttccaaaccaatctttgggggagaatctaatctcttttttgccaagctggtgaggttttcttcccccacattgaatgtttatatggaaagatatgaaccataaacatttttatataaaaacttattctttttgctttttattggctgcattgtaaggagtcatttggcctagagggaaaggagggtaacattccctatggcaaactacaacgaatcttccttctcctttcccaactccagcagtaatgatggaaaatcagtgcagcatcctagtgcattcgcagtgtggtttgacaaagaccataatgttcttgtcaacataggtaacagatcaatgtccatctgtagattccagtactttttcttactaagaagtgattaacagctggatgtaatatgtctactacagctacctagttttgtaaagcatatagttaattaaagggcaggaatcaaaaacatgatcaactctgtaaaagccctgagcttactcagctgcttcttgcaaacttcaacctgtggggtaaagagacatttgttgggtcatggcatgcttgcctctgaagaagatcatttcaaagactgggcctttttttctggtagcctagatgcaggacacagagttgctcattttgccagagtctctttttgccttgccaaactgacttttctttcaaaaaactatgtggaaaattaatgtgtaacttttcaatgataatattttctctttgtttggttttccccaatgatttcatatctatactaaacatccatcccaaataagttacacaggaagtggaggccaaagctaaaacaaactcacacccatttctctggcaacctatttaaaaaatagcgattaaaaatcaaaacattaaacataaccctttctggcgagataactctcccctaggttacattagaaaacacccccctacgtttacatggcatctttgctgtttatgatcttagttttcattattgtggcctaacaaaaatgtataaagcttaaagaccagctggagcaacatagcaagacccgagctctacaaaaaatttaaagcattggctgggcatggtggcgcatgcctgttaattactagggaggctgaactgggaggatggcttgagcaatcctcctataaccaggagttcaaggttacaatgagctatgatcacatcacttcactcaggcctaggcaacagagcccgacctgtttctaaaaaagaaagaaagaaagaaaaaaaggtttacagatattttgacactgcaaagaaatctcataaatatctcataaattattagtgacctgcaggaaatgaaagctcagcgttgcttcttttttcaccgctcctgatggggctgaacagtttctttacacccttgaatgcagtctgtcgtggcatgtgggtgtacatccttctctcttaagacaagatgtaatagtaacccatgatcttgtaatctcacataacaaggcattttgatctgcagtcctggttgttttctttaagctaaattttattttttattattatttttttttagagacaagatctcactatgttgcccaggctggtcctgaactgctgggctcaagtgatcctcccacctcggcctcccaaagtgctgggattacaggtgtgaagcaccgcgcctggcccctttaagctgaattttaaaggaacttagaatctcattctcttacatttttataaccaagaaatgaaccctgacggtaaagactattaatatactaattattcccagcattatacacttcatgtgaaaggcagatgaagaaaatgaagaacctgtcttctgttcaactaaaagggaaatttagctttacttagttgtatctgtaattgtccttttgtttttaagaatataagaatataaagaatataaataattgcaataaaacaacataagaagttgaccaatggaacaagaatagtatagcacttagtaagatgtacagatactattttaagtaccttgttttaaagttaagtaatgacagcctccagttaataaaccagaaataaactctaaccattatttcttggatttcagatatttttttctttatagaaataatgtgatgtatagtgttccttttactgggtcagccaacaaaagtatttacgttgatataaataaaatactttttgtaatcaaatattctagctcacaatgaaaaataattttaaaatgtgattatttagtacaagtaaacaaactttaaaaatacaacaacaagatttttatttttcatgaaataaacaacagtgagtagaaggaaattttgaggatgttcttgagaagaactttttgacactttagaaattgatagacaaagcacaacttagactttcctttcacttgatactaatatgcccccaatcctgttctcccatcattatagttatttttaggggtcacaaatggaacaaacataaagaaagaatgagggatgacagtggaaaaaatggaggtggaaaagagaggaagaaaggagaaaaaggaggaaaaaggtagtaaaaaatgttcttgaaacagttggcaatagttacaaaagtgagacgaaaaagtgcacgggttaaagatgataaaaacattgcttaaggaagaaccaagcaacctgagagttctgaaaataggggaaatggggaatgcttggaatgtgtatgatctccccagaggaaacaatgttgagaaagaaaggaactcgattcattcccaaagtgggccactgggtgaccatgaaaggccagcgcagcctggtgctctcttgaccaagggaaacgtgggttggaggagtaacttcaggtaaaatcaaggtctgtggagatggagggtccatgtgctcggaagatatatgttctaaatgtagcaacacatgtttttttttttttagaaacaactttattgacgtatcatttaaatacctttaaattcacctgttttaattgtacagttcaatgatttttggatgtactgttgtgcaaccatcaccacaaaccagttttagaacatttctctcactccagtaaaatctctcctgcttcattacacttactctttgttctcactcccagtcccaggcaatcactaatctgctttctccatatatagattttctttttctagatattttatataaatagaatcatgcaatgtgtggtcttctgtgtctgtattctttctcttagcatgtttttgatgctatccatgttgtagcatgtgtcaatatttatttttattattaaatggctttctattctgcttgaagataaacacattttgtttttccattcactagctgatggtcatttgagttatttccaccttttggctattataagtaattctgccaagaacacttgtgtgttgaggtctttgtgtggacacctacgtgcatttcaagcaaaacgtaactaagagatccacctgctcatggaaaagacaaatatttaggcctgttgtgttctacaattctaggatccaaaacttcacatacacactctccacatggcaaccagaatggactttttaaaacagaaaatcagatcacatctcacctgattaaaatttcccagaggtttcccatcatactgagaatgaagcctacatgcctttccatagccacaggactctacctcatctgacctcagctgacatgtttcactttatctcgtaaccacttctcttactctcaacttcactcatattgatcttgttgctcctcaaatataaaagcttattctgacctcagggctcatacatagtctgttccatttgcctggaatacttttccctaatattcatttgactcaatccttctcatccaggtctcccctcaaatgtcattcatgtagagaagcttttgatggctgccctatctaaaacagcagccatatctctcacaatactacctttgtttttcttgagacagagtttcactcttgtcacccaggctggagtgcaatggcgtgatctcagctcactgcaacctccgcctcccaggttcaagtgattctcctgcctcagcctcccaagtagctggaattacaggcacctgccactgagagacaggactagctggatttcctaggctgactaagaatccctaagcctagctgggaaggtgaccgcttccacctttaaacacggggcttgcaacttagctcacacataaccaatcagatagtaaggagagctcactaaaatgctaattaggcaacaacaggaggtaaagaaatagccaatcatctcttgcctgagagcacaggggaagggacaatgctcgggatataaacccaggcattcgagccggcaacagcaaccccctttgggtcccctccctttgtatgggagccctgttttcactctattaaatcttgcaactgcactcttctggtccgtgtttgttacagctcgagctgagcttttgctcgccgtccaccactgctgtttgccgccgttgcagacccacgactgacttccatccctccagatctggcagggcacctcctgatccagcgaggtgcccattgccactcccaatcgggctaaaggcttgccattgttcctgcacggctgagtgcgtgtgttcatcctaatcaagctgaacactagtcactggattccacagttctcttccatgacctgcggcttctgatagagctataacactcaccgcatggcccaagattccattccttggaatccgtgaggccaagaaccccaggtcagagaatacaaggcttgccaccatcttggaagcggcccgtcgccatcttggaagcggcttgccaccatcttgggagctctgtgcgcaaggaccccccagtaacaccaccacacccggctaatttttgtatttttagtagagacagttttcaccatgttggccaggctggtcttgaactcctgacctcaggtgacccacatgcctcggtctcccaaagtgctgggattacaaacatgagccacagtgtccagtcctctgttttatttttaactgaaaagtctgaaacttattgcttgctgtctcccaaacagaatgcaagctcagtggggcaggtactttgtttatctttttcactgatgtatctccagcacctagcatatggtaaatgttcattaaatttgttaaattaatgcagaaatgaaaagcagaaattggacctcttcttacagttctatactttatccctagaatttctgagaagtcagtttgatcatgcaatgtattcagtttgtaaatttatatttttatttatctatttattttcgaataaaccttttgcagtcttatcagtttgtgaattcctaagccaactgaccacaagtctaatactgacaaatcatgggccagatttggtcctcacatctatctgtttgatgtagcaggtacgttggagcctcctttccatttctttggcccactcctatttcagctgcagctgcagtgagagttccctaggagctcaggctcacctcattgacaggatcacacctcaggcagctaaagaattattccatttttctgccttgggcctctcttatgccctagagccattgggcatgtgtgtggaccacttccggaccatgtttatgttccccagtgcaaatatcagccatcagccaacatgggaaccaccttcatccacacttccttcaaatggaaagctctggaagacatttacacttcccagtagtcccagcagaactgatgcgctcttcccttcagcagagacttgaataacaccttcttgtactgacttctcctgtgtcatactccctgttcctttacttatgttttctgggattacctcgccactacacacaatctgcagccaagtctttgtctcaacctctgctttcaggggaagccaaattaggcctatgagttacatcattaaaaaaatttgtaaaataattgttcaaatttaagcttgaaatatttcaagttaaattctgagttcttaacttcctactttaaggtgctgcatgtaacttcacatacaataatttttatggttcttatttggtaaggaaaattattgtccattagcttgttttcaaaacttcaacctttcaggtgttcataggtcatttcaagtgttttgtgaggaaaatggtctcaaaatctctagtctgttaggaatgagaagagatggggaattctttttactatagaatgtagcaggaaaaaaatttaaggagttttttgcttcattagatttgctgtggaatgagaaatcaataaattaatgactacagtgctaaaataaataattgatcagtgcttgtgaatatgatctcctcttcattactaaaccaactcagccttatcgtttccaagctaaggtaattgtaacctgcaaccagcagaagaaccaaccattttgttttggtttgaagcctcatgagtacaattcgttcattcaagcatttagtaatattaataaaaagagatgaattgcaatagtgatgcattcttgcctcttcacaacatgttttgcttataagaggacattatcttccccccttcagtggagtcagttatttgcagttcttgtcccaggtatagttttacatgctaatccctgcctgctttttttttttttttttaatagggctagggtcccactatgttgcccaggctggtctggaactcctggcctcaagcaatcctcctgccttggtgtgccaaaatgctggattacaggcatgagccaccatgcctggccctgattccttccttctgagtagctcagtttacttaaaagcaactctttatccctgaagcagtcttggcatttgatcttatttaggatgcagattcccctaatattttggagaccattttctacacttctggtgattgatacaatgcctcagtttgcttatgactgaaacaatcttgtaatttatgattcctcattcttctgtgtctgacttgtagaccatatcaaatttgtcatgtctaactataactctaatactctcctgctcttttatacccaaatcttcagaatgaatattgggaataccatattatacatggatctctaactttttgaatgacctgaagcttttcctttaaggaaatacctctctgctccctggccggactctgaatcccatgacattatggtcccttccacaggagtgagtccatcatccagactgctcaatcaccgcactccaccatcagttccaggattggttcagggagccacactggcccaaccagttatgtaactttgctgaaaccattaggagagaggttacatctttttcttttcattgggattgctctagttaaacataaatccaaagctgctggtggccatttttgccaaaatatggggaatttttctttaaaattgactcagtagaaagaaaagaaagggcttggcatagtggctcatgtctctaatcccagggattagggaggcagaggcaagaggatcgcttgagcccaggagttggagaccagcctgggcaacatattgagacctcatatccaaaaataataaaaaattagctagacatagtggtgactctctgtggtcccagctactcgggaggctgaggtaggaggatcacttgagcctgggaggtagaggctagagtgattgttatcacaccactgcattcccacctgggtgacagagtgagaccctgtctcaggaaaaaaaaaaagaaagaaggaaagaaagaaagagaaagataaaaagaaagagggagagacagtttaaaaaaaagagactgaaaaagagaaaaagacagacaaggagtaaaagtctctgtcaaatgacaaaggaggccaggcgtggtggctcatgcctgtaatcccgacactttgagatgccaaggcaggtggatcacctgagatcaggagttcaagaccagcctggccaacatcatgaaaccccatctctaggccaggcatggtagctcacgcctgtaatcccagcactttgggaggccaaggcgggcggatcacctgaggttgggagttcaagaccagcctgaccaacatggagaaacccccatctctactaaaaatacaaaattagccagatgtggcggtgcatgcctgtaatcccagctactcaggaggctgaggcaggagaatcgctttaacccaggaggcggaggttgcagtgagccaagatcgcagcattgcactctagcctgggcaacaagaacaaaactccatctcaaaaaaaaaaaaaaaagaaagaaaccctgtctctactaaaaaatacaaaaaattagccaggcgtggtggcaggcaggcgcctgtaatcccagctacttgggagggtgaggcaggagaatcccttgaaccccggaggcggaggtttcagtgagacaagatcgcaccactgcactccagcctgggcaacaagagcaaaactccatctcaaaaaaaaaaaaaatgacaaaagacaggcatcatttaaacctctgtgctcagccacacctgaagcaaacaagatctgtcttttccattttcttagacaaagaatttttctttgcaaaattacatgacttatttttcttaagcaactttgaggtaaatttttgttacctgcacttggaagatgcctaatacttgctatgtctacttggagtaggattgcttgggttcggctatgtccctagagatgtcttttcttcctccatgaagcttgtcgttattaccaggatcaattatctggagaggagggaggccctcaggtagcaactcagggcgaggggacaaggctgaggtgtatggaagctcccatccctttctgggtcttaatgatgacaaggccaaatatttgagaatatgtacttgcagaaacagacctcaagaaaggaaggaaagagccctgcaatgggttaaaaactgaagacgaataagctatgcaatatatgttagagtattttgtttcatggtcctactcatagtacttgttgccattttgttacattctaaccttcagtaaagcttaattgggcatcaattctgcctcagttgaactaaatggtatgcaaggaagaactatatgtccatatatgggacaaagcactgaaagcagggcattagtttttgcctttcgaggtcagcaggtgatacagtcaaaataatccctgaggagagtgtttcaagctagtagttgggactgtaaggtcaacctcccctatcaagaagagatgctctctcattgactactttgaaacatctgggttttatttaattaaggaaggcataaatgtatcacgccaattatatgaaagcataaaataagacatctaaagtaaagaaaaagattaacatcccaaataagaaaagcaacaatgctcaatttcttttaatctaaaaatctattaagacttcccaccacactttcagacttgggaagagatggcagtgagctagttaagggcagaagaaacaagacatagatacattgatagaagtatagatacaatgatagaagggggcttcacggatttttgctggcaggcaggaaatcataaggtagttccactaaagcttaaactttgtggcttttggaagatgcatcacccttgttacttagaagcatgcccagcacatagtaggccaaaatgtgaggttggggctatttatattcttacctcagattagaattgggcctaaaaaagaggcatagaaagattctgaaggtggtactcatgtgatccagctgctgagatgcggcagaaggaaagcagagacctctaacccaacttgttgaaaagcagctgaaattactgcattcagtttataaacaataatagtccaatgataaattttaaaaatctctgtgagactaagaatgctgcccatttgctcctctggaacagtagcaagtacagtgaagggctagcaccacagctttatggaaggaattgcctttactttccatttccaaacctcatattttgttttcattgagtcaattattaatacatttcttaaaaatttccatgcttttaaagagagctattttcctccttaattttttataccagctggagattgacccatacaatactactggtaggtggatgaacatttgtctttcttaacttttaatattatcaaaaagtaaaacttgtaaagaaacatttcattctgaaaccaatgttagtgctgcaaaaataatttttggaacaatatcttatgatacagaagatctatgtcatccaaggagcctcactgcaaacaatacaaatggactctgcctgatatgggcagaaaaaggatttattgaaaggctattggttagcctgcactgtccaggacagcaaacaggcccagaggttgtgcacccagagatacaaccaaaatcatatcacaaagctggtcctatgtggacgttgctgctgctgccacttagcatcagatatcacagctggcccaattggcattatgtgttggatactactgtagatgtggctggccatgctatctttagaaactagacattgctgctacagtcacaagcagaaatgttcccttctctcttcatgtttgcaaaattagcccccaatttcaaagtccataggtttgaatctagagtatatacccatgttgcatggaggactggaaagtaagtatctagcattttgggcttctggggtgaatggtgaggtgtgacttccagcaagactcaaaaggaagtgaggaatttcccaaacagaaggaggggaaaaaaacccataaaaacagtgaccactacagtccacacctttgaatgcctaactacatatattctcttctttatttatctttacttatgtgtctacctaatacgatgcagatatatccaaaacagcaaaaaacacattcaactcctctcccaagagaaaccaaaatgtaatcagttactgcatccagcttcaagtccagaacttctgggtaatgatgttcattcatctcccagttcaatcataatcccatcttgatataaactatggattacattgttcaaattcattaccaccacttaatataaaataatgatgagaaagaaaaaataaaaggaaaattagttaaaatataaatatgtatcatattttaccaatttaaaatacatttttccaataatttaccatgtctgaaatcaaccaatggcatcttataattgctatcaactgggtggcaattgtgatgtaattctccttgccttagtattaccttaactgattttttagaaaaattttagtgtttgcagaagagtgacatgtgatggaaatttgtgtctaaaacccctacaatctctctctcgaggtataaagtaaaaattctaagtgaaagcaagcagcatcacatcatagttcagtgggaagtgtttttctttcatagaaataaaggtacataaatatgccttggagagtcaatgaaatacagtacatgatacagaaaaaaaagtgggggcagatactacaatatacgtttctgcaattgattacaaattggcagttgccatatagcaacaaattccttatttcaccagccatcccatgttccctttccctccagtccacatctcggattgtcagtattctttccctggtagagtgacctagacttttattactaagggatcagagccaaaaggtggtcttgtttatgtaaggttgttgcaatctttcattaaatttttattgtagacatggcagtgtggaagttaccccagagaccctctttgttccacccatactctttccttctaatcattagaagcaacaccatttactctctatagacgtgatcaatcatttaatccaatagcataaaccattttatcctgcttaccaagttattagaagatataagcatggtcaaatggcaatctcagcttcttattcaatggaatactgtttctcccctggtggatgcatcttctttttgaggtactaaaacctctaaacgagcaaggttcagaattacagaaatgagaagtaaataatttgcaaatggatcattagaagtaacaatgagtcaccaactcctacttccacagcttggtttttagggtgtattgtggctatgagggaaaaagagcaacattttttggttgatatttcagagcagtggctctcaaactttaacatgcaccaatacttttttagagggtctgtttaaacatcagttgctgtgcccactccaagacttcccaattcagtagttctaggatgaaactagattatttgcatttctcacaagtacccaagtgatgctgatgttgctggtcttgggatcaccttttgagaactactggttcagagaatataacacattctacaggacagtgccacaattttgcattttgtcttatagctgttcgtctatttctagttaataaacatatggtaagccataaacataagctctactgcttatttaattaaaaatggctgtccagataaaaagtaatgtgtacaagataccatgatggtatgtaagtaagatgcctttataatttgtcatctgaactggggtgcttttgagggtgatgagggctactaattacaccaggacaacagcaacaaactggaactgacttgggtgaaccagatatgatccccctttgtaagaggtatttagtatatacaggatggttgtactagcaagtgtcagacacaaatgttaggaggcggggcatggtggttcacgcctgtaatcccagcactttgggaggccgagacaggcggatcacctgaggtcacgagttcgagaccagcctagccaacatggtgaaaacctgtctctactaaaaatacaaaaattagcctgatgtggtggcacatgcctgtaattccagctactcgggaggctgaggcaggagaattgcttaaacccaggaggttgcagtgagctgagatcacaccactgcactccagcctgggtgacagagcgagactctgtctcaaaaaaaaagaaaaagaaaaagaaaaagaaaaagaaatgttagacaggaaaataaatccaaatccagaataagtaatagtacagtaaggatgaatttctatctcttctgtgatgatagacagccaataaattaacctgcctccctgtggctgaatgtcctcctgggatatgatatcatgtcagaggttcaagatttatttctgctgctagcaagttgggcaatcagcagtgacagccagcattggtgatgaaaggtccatattgttgagcttgtgcatactctgcatccaagttgctgtagacactttgttcatgagcccgttgagtgagccccaggatcaatggggaagaagaatgactaacatttgcagagtggattattttgtccactggtttactaaacctccacagagttttttgttgttgttgttgttgttgttagcagttaagatatttttgacttcaaaaaaataaaaaccttggacagttgatataaaccattaagaatttattacttcacatgttaaaacgttctaagatagggtggtgcaagaggtagttgattagatagctcaacaattttattaaggatccaggtccttcccatctttttgctttgccatcctgagcatattaccttagcttctttcatagtcataagaagactaaggtacttcaggagagacatcttcacactaacatctaaaggcagaaaaggggactatttattgtttgcattttaatagataaagaaactcccattgaactaaccccacagcagactcccttcaatttctcattggctaaaatggggttgtatggccctttttgaggctcacgagggaaacagaatcaccatgatcacttagattcactgattcacctgcaagcgtagaggtgtggtcagccttctctggagcataaagtcacatggaggagcttggacacctgtacaaatctgaagttttgttcacaaagaaggggtatagctattggattgacaaccaatgttgtcacacttatatgaatcccaaatgtcttcgtatgatagtcccattttgagacccatccagacacttgtcaccagtcctctggtctttatctttccacttccatgaaaatctgaccaaactatttgttactgtccatcagcatttctctcttgctggaaaaatcaaggacgatataccactcaagctctgcatactaggataattttccttctccaccttcactttggtgggactgagtggaactgagtagcacttcagtaatctattttgtacatttacttttagtgatgccagcttactctcagagctatatgtaaactatgctagttttcttcagttaactggtaatggagaactattcatgaagtcatgatggttggcagagaggtggcggtgtggcatgaggatgaatgccaggaagaagagccatcagtatatgaaacttgagctctcaggacatgctcagatgcactcacatatatactatttccactcgaatatgtctgactttatagctgtgtagatcagataacattcacttcatgataggcagcttgtgtttcacagtcatctggtttctatctgggcccagtattaagccaagtgctattccttcaaagaagaatgaatggctactcactgaagaagttatagctttgctctagaaccctgacgttcctgctgcgaacttcgtattcactctttctgcagactcatttgatttttgagtaccactggtcccactgggtcctaagggccatataaaaaaagctgcagcctggaccagctggagcattcctctgggccctactcaaagctgttagcctttcagatcactcaagaaaaggagctgaagggcacacaaaatgagacatatgttgcttctaaaatccagagaccaccatcccacatagtactttttcctagaggtgggaaataaattgtccttgacactgaaagtataaactcacatgtcatgcaacactggatcccaagaaacatcattgaattatcatgagatttatttctactttctggcatgcatggtcttaatctaaaatactagccacttgctgttctccagagtcatcagaatgttatcttcagcatatccctggatgatgagatgaccaggttcctttagagcaacttatggcacagagaatggagaagtaacataactctgagttgaaaatatagttctgctgttttaggtaaagtcaaactacttctgatgtgctttctgtgtttgctgaagcagaaaaaaaaaaaaaggattgtccagatgaacgctgcaatcaatatcccatagtatgtcttgattcactgtgataaggatactacatttgaaagatcatatgtacttgaaagacaagtttccacttgacttagcctacagttatcccctagaattatctaagactgatccatcttttgcactggccagcagttgaagaattaagtggggatgtgataggaagcacagtgaccttcagctctatgatttccccaggaatgtagtgcaaaaaaattacaataattttttcaatgaagtataacagaatattttttgatttactattttgacagtgacggtaacccctgagctttcacaaagtcattcttaaccatgataactgtgttaaactctattctataggtcagagggtcagtgtcagaattctgccatttactgaggttatttttactaataatatgcccggaaactgaaaataatcctagcgagggttcaggggcttattagaatgcatttgtgttcagcgcagtggaccactctaagtattttaaatacaaagagtcttaagacagagaattaagtgcttataaaatcattggaaagactggggaggcaagtatcagaagggcaccatgggccaggtgcagtggctcatgcctataatcccagcactttgggaggctgaggtgggaggatcactttagcccaggagtttgagatcagcctgggcaacatagcaagacccccatctctataaaaaaattaagcaattagccgagcatggtggcacgtccctgaaattccagctactcaggagcctgaggtgggaggatcacttgagcccaggaggtcaaggctgtagtgagccgtgatcacaccactgcatgtcagcctggatgacagagcaagaccttgtctcaaaaaaaaaaaaaagaccctaccagaacgactgagttaacgaacacaacaccaaagctacagccactaatcctggagtattttccattattcaactgaattaggcccctggtgggctgctcatctgtttttatctttgtaactccattatatgtaaaagatttctggagatgtttgaaggatgtatcattttgaatgccataccagctctagtgctattattattattattactactattattattattatttttgagacagagtctcactctgtcatgcaggctggaggagtgcaatggcatgatctcggcccagtgcaacctccgcctcctgggttcaagtgattcttctgcctcagcctcccgagtagcggggactacaggcacgcaccaccacgcccagctaatttttgcatttttagtagagacagggtttcatcatgttggccacgctggtcttgaactcttgacctcaagtgatctgcccgcctcagcctcccaaagtgctgggattacaggcgtgagccaccatacccggcctctactgctattattataggagcatgcccaccttaactttgccagttaggtgccactacttgtccttttccatcagtgtcactgttgaaatcaggagcccttttcaaccacagagtattctctttttaccccagcacatgaaaaccaccaaaatgccttttaagatacctatgcaattcttgagcccctggtataaaaaaggttttctgtgcatttcttcctccttctagaggaaggagactgttagggaataagcgtgtagttcacatgtgataatctaccccaatattctcatctccataacctgttggcttccttcacctgtattcttacaaaaatgtctagcatttcctgttcatttggaatgaaatactactgagcacagctcaagagagcaaataatttacacaacttgcagctgcttaagccagcaccttaaatccagaatctccaataagtgtatccctattgctgaattctgtgtgatctatagttatgctcttcctttcttggtctagtactctcaatccatttccacacatattctccatattatgccagcataccttagcactctttcaattcctttggtgagaacatcttctgctcttgaatttggctttgcagttgaactcctgaggcatatgggatctgaatctacacgcagttctggtgatcttgagagacagtgggagtgggatgtgaggagaagtgacttgccttgcgaaactgttccctagactttctcaagtgagagtactgagaacccctgacagtaacagcatcatcagacaggaaggctcattgggctaaaaatggtaaaacctgtgtgaaattggcctcaagagtctgcatgtttattatgtaacatagtaaggattctgaggcaaggtgggcttcagcagtgctacatgcaggttctggccctgtttttcttcagttctcttgttctgctctctgggaattagctttgtcctcaggagggaatccctcttggttgttagggtggccaccagagcataacgcttcctatgtacattctgtaggagagacataatcccaaagccacaggatacaagtcctcccattcagagtgatttgccatttctacattgttaagagccaccatggaaacggcattcattggacagctttcgaggatgggttcctgcgcttatacactgttggttggaaggtaaattagttcagccactgtggaaaggagtttggagatttctcaaagaacttagagctactattcgacctagtaatcccattacagggtatatatccgaaataaatcattctgccaaaaaaacacatgcactcatatgttcaccacagcactattcacaatagcaaagacatgaaatcaacctagatgtccattaacagtggactggataaagaaaatgtggtacatatacaccacggagtactacacagccataaaaaagaacaagttcgtgtcctttgcagcaacatggatgcagtttatggtcattatcctaagcaaattaatgtaggaacagaaaaccaaataccacatattctcacttataagtggaagtgaaacattgagtattcatggacataaagatggcaatgatagaaactgaaaactactagaagggagagggagagagaaaggcaagggttgaaaaactgttgggtgctatgttcagtacctgggtgatgggatcaattataccccaaacctcagcatcatgcaatatacccagataaaaaacctgcacacatacccccaaatctaaaattaaagttggaaaaaaaacaaagaagattgggttcctgaaccagtcaccagcaagggagaagaaattcacatgatggttcattctaataacatttactcctatacataaggataggtcaaatgcctgaataaaattggggtttctattaggaaggaggaagagaaaaggtccatatgatggaacatctattgaagctaaaaatgttctctctcatccagtaggcagagaagaataacagtaatatagcattttagggctaatgctcaatcttggaaatacatgcattaatattttgctttatatttactctccgtagatagctccactttggaatagtagggcttttactttatggtggaaattctattcttttttttttttaatcattcactatgactaattggatgtatatctacaaaatgactacctgttatttacctaaattttaaaaattttggctggacacagtggctcacgcctataatcccagcactttgggaggctgaggtgggaggattgcttgagcccaggagttcaagaccagccttggcaacatagggagaccccatctctacaaaatatattttaaattagccaggcgtggtgatatgcacctgtggtcccagctactcagaaaattgaggtgagaggatcccttgagtctgggaggtcaaggatgcaatgagctgtgattgcaccactgcactccagcttgggtaacagagggagaccccatctcaaaaagaaaaacaattaattgcaatttcagttacaaactagttgaaatgaaataagtgggagaaaaaagtagtgtgtgcatttctttatatagaccttttgataaaacctacactttctaaaacaagttaacattttccaagtctggtgaatttaaaatggttacaaaattgtttacaacttttttcatcaagagctggagttggccaggcacggcggctcacgcctgtaatcctagcactttgggagtctgaggcaggcggatcacgaagtcaggagatttagactaccgtggctaacatggtgaaaccccgtcactactaaaaatacaaaaaataagccgggcttggtggcgggcgcctgtagtcccagctactcgggaggctgaggcaggagaatggcatgaacctgggaggcggagcttgcagtgagccgagatggctccattgcactccagcctgggcgacaaagagagactctgtctcaaaaaaaaaaaaaaaaaaaagagctagagttcattttaccaccccttaaattcaagctgtccttataacttgctttgaccaatagaatgctgcagaagtgacgatttgtgacttctgaataagacctcaagagaacctagcaaaacaaataaatcagtcttttggtgggggggattactatttctgtagttctttctttattttatttatttgtttgtttgcttattttttctttctttttgtcttttttgagcaaataaatcgttattttaagccactaagttttgaggtagtctttatgcagtaataaataactgatataccaaccctttcataaggattcatgttctatcattttactgggatttgaagtgtgttgttattcaaccatacttaattagaaatcaaacattatagataaaagctttttgaactcttagcctcaagtgagcctcccacccagcctcccaaagtgctggaactacaggcataggccaccgtgccccaccagataactttttcaaagaggaataacttaaaaactcagtcctattttatatgcagaaaaacaaaaatagcatataatctctatgggagtgaaatataagtatgtaacttcacgcatccctgtaaaatataatgcgatggctcagagcagggactgggaaaatgctattcctctcctgtttactgcaaacgctttatgagcccctaccatatgctcttgtattatatctggtaggtacttttgggtgagggttgtgtggggaaatgaaagtgaagttggggaggtgaaagctccattaataaaataaaatccttaaccaattaaaattttaaaaatatatttaatgttatctgtatctcattattaatatgtacatcatattctaatgacccatgtattattagataatacatgtatataattcatgaataaaaatgtatctctgttgagcaaatgctcaaaaattttttatacgcatatgtgaatgatcaaaaaatatagaggatgggctaggaaacatggtagcccttttaagagacaaatatagaagcaaactatacctgccatgtaatataaataagcacacacatgcctaccagatatcatgtaactggcatgacaaagtcactgggaaaaggcatacctatctgtaattattgacctactctgggctatgacattataccaaactctttggaggaatcaaagatgaaattagaagttttcttgactaacatccaattcttttggaatttccctttgggggcatgttattttagggtcattctaagggttcatgcctataataaaatgttataaaaatatccctggagctaccctgcccactggctcattttctgagtggactcaacagactggtggcctggggtttgttctgggccccttgcctcaggtgcaccctggtgtgacctcacacaccacaaaacagcctagtgttctgttttgttttgcttttttgttttgagacaaagtcttgcactgtcgcccaggttggagtgcagtggcttgatctctgctcactgcatcctccgcctcctgggttttcaagtgattgtcctgcctcagccttccgagtagctgggattgcaggcacccgccaccatgcccggctaatttttgtatttttagtagagacagggtttcaccacgttggccaggctggtctcaaactcctgacttcaagtgatcctcctgcctcggcctcccacagtgctgggattacaggcttgagccaccacgcctggccaaaagagcctagttttaagctaagagttcatggcgctggggcattttattcctccatttgcctagcagcttccactgcagatgttttcttacccttctggctattttcacctttctttcagtggcttttttttccatttttaaaaattcacaggcttcctgtttctaagtatttaccacatttctgttcatgctttttccctgacttttatttttcaccccttcttagccctctctcccaaccacatctgttttactccctttcattttttccccattcctttattccctgctgtcctgtttttctttgttcaattcagaacatcagccggaagcttccctgttgctaagtaaccacatcacccacacacacccttttccattttcaacttatttcttctgttttaataaactcatggggccgaacagtctctaaaagaaaacgagaggtgctgctgtcttctcttcatgcagcagagatgcataccctctcatatcctgccttttcttattagattttggcttcttgttttattgataatttgccccagactgtgagataacactaaataagcacaaaatatctttttgggcttggacaatttgcagaagggaggaagagatataatttctgcagaaggaacaatgaaaatgtttaaaatatagttacaaggcatggcatgggctcattgaagggtgtttgccttgaccccggaaccaaatccagccctccctagtaaaaggtttccattagggatcaagttagctagcaagtccctcttaacattgttgagttgtgaggaagctactaatggcatggtaagtgtgatttgcacaaaatgaaggataaaacaatacaagaaatcattatgtggttttccaaatctcaatccttttccagacatcaatctgacatggcacttgtgccaaaggcataattggaggtgtgtgagcccttctcacaatatgctcttgagggattccaagtcttctggcacattttaataatttaatgggaatggtaactccatatgtccaaacactagggcagagtaacagagataccaggagatttgaaaaaaaatcttttcacccttgcaataccataaataatttccttgcctggtgtgaattctttctctgacctcttgcatttatgcaatgcctgggaggcctttcctgctaagcccgcccccacattgttgctctcagctttttgcccacagtgagcactgtgctaattgggtagatttgggagctgcttcttaagaagtatcacggccgtctatgtaggtgtgtgtcccagctcctctggtagtgctctgtgctctctgtcagggaagggctcgtatccagcatgtaatgaatactcaataagttgccttaaatttaaccacagaacacagacactctgacaaggggattatttttagtttcattttctagatagaagaacagtggttttcttcatattgaagtctaagttcatcaatcaaagtgccagaaatgaagctgatgcatttccatcactatcctgaaatgcagatggagcatttcagtagagggaaatttcaaaagctttatttgtcaagacctgttgatattctgaaagcagaaaccctgtaagactaaaacctactctaaggtattctaagaatgcctagccagaactggaattggcaagctttttctttctagaatctagcccctttgagatgttaggtcttctgagagtttcagaaagttttaacataatttcaacttttatcttagggtaacctcaactgatgaaacatacatttgaacctcctggaatttttattttatgtgccacttactttaaattatacaaaaccttcactgtcttccagtattcacttctcttttaactttcttttctcaacttgagatatcaggaaacgccaccatgtcatattttcttttcttacatttttgaacatctaattccttttttcctttccgtcctcctcatcaatgtggtctagtcttatagggaacttttctctccaatcacaatcccctcctcttccacttctcgcttagctactcttcccacaccccaaaaagactctcgctttgtgattccagtcctggaattctttccctattagtgtcctcttcacttcactgcttccctaccccatggagctctcatgagccatccctttaaccattctcttcagtatctcagttcccttgcccctcattggcctggcaaatccccaaacttcaatgagttcatcttcatatctccctgtctgagcccaggctatctctcctggagagagatcacaactctgccatggatgccattccaactctgtgaccccaagtactggtccctccaggctggtcccagcagtcctcctgggtttccttctcatattcctcctcatctgctttttttttttttttcttttttgagacaggctcttactctgtcacccagactgagctcattggagcctcagctcattgcagcctcaacttcccaggctcagatgatcctctcaccacctcagcctccccagtagctgggactacaggtgtgtgccaccatgcccagctaatttttgtattttttgtagagataaaattttgccatgttgcccaggatggaatgaaactcctgggctcaagcaatcctcccgcctcggcctcccaaagtgctgggattatagccatgagccactgcacctggccttacctcattctttttagctcctcattcaattctacagtgaggaagcaccaacacttactaaactacttcctttttattaaacttcattttctgttattacaaagaatgtgctaatgagatgcttatgcatttatttttgtttatatatctaagtatttctgtaggatacatagaaatttttaggtaaagtggcttgaaatttttaggtataggagttttatactttttgcttgtaaatatatttaaacatgtgcaaacttttatgtattaaaataggcaaaatacgtaaaaccttaattcacggaacagcaaatctgaaccaatgaacatatataaagatactcaagctcacttatagccaggaaaataaaaattaaacattgcaatatcactttatagctactaaactgtcaaaaatctaaaagaccaatacaacctattactggtagaaatatgggagaaagagttgcttttttgggggggggacgggggggaaacaatctggcagcatctactaaaatttaaaaaacatatatagacttcaaccgacaaacctactaactcttagagttcaatcctataaaatagaaggccaaaaggtcggaatatatagacaaagatatctttgggaatattcatttcttcctgcaaatatttattaagttcggactatattgccatcacttcacagatgaacaaggcacaggccctgcccttaagttactcacagcctgtctggagacagatgagtacacaagcaactggagttcatgagcgaggtgtctagaagcaatctgggcctgggatggaaggctgcaaagacttcactgaaaagcaaatttgcaagactgtaaaatacaacatgcttccaaggccttggattaagttgtgtggtccaggatagctgaacagagtaaagatacctggatatagggaaaagataacccataaacttttcacgaaacaaaattgtgttaataaaagtcacaggtactctagttactctagtggcagtggagacagaatatgagatacacaatgaaaaaagaacttactttttaggaagagaattaaaagagtctattattaaatggtagccaaaatgctgtttttctcgtatacctggcacagaacctactcttgaaagctatgtgttgaatcaataaagtatgacatgggaacagcatataaaaaggtttagctcagataaacttgaattcagtcaataatctcacctatttaagatttttccttgaatagacttttttccttccttccttcctccctcccttttccctaccatttttcaggcgaaagaaagactggtcaaataggggttctaaatcctgttaacctcactttaaccctgttatttcaccatttaatgacaaggcaaaaccatcagctcttaaatcatgaactttaaatgccaaaaacagtgttgagaaatttttaaaatatgagtgttatatagaaaaagaatgactaacactaaaagcaaacaaaacaggcagttcattagaaaccggtaatatagaatagccccgattttgtacctaacagatctcggaaagggactgacagcccacagagaaacaagagcagcacatcaagacgaaggcacattttcttcccaactgctgtcatttaaggaaaacccatgagcgtgagttctcttatgggagggtagcgacctccatgaaatcatgagaacattcccccagtctaagtgctgcctggctttactcccacatcaacagcaaaacaactgcatagcaacctacatttgcccatttcctcactcattaatgtttgtccagaggaaacacccctgccagtccctgtctgctttgtaaagtatgtcaaacaggagttgagtgtgtacgccagattgggaagtgacacatgctggcatttctcagcgcatgcggctccccactcggctttctggagctctgccttttggcgacagagcagctagagctcctctcccctcccccatttcctctcataaagataaccagtaacaacaattggcgtgtgtgtgtgtgtgtgtgtgtgtgagagagagagagagagagagagagagcgctcccagttggccaagtaccctttacatccagtgacctgttttacgaataataggaaagactttccagcttattttctgcattctcaggagtacgcagagttcacagtaaatgcagagtaacagtcatttctaaaacaaagataaaacactccaaatgctgctctgcaaagaccatttgccatctgttcctttccccctgacagggctgcttatcaggactccagcaaggacaccatcatagcaatctagatccgagtacttttcctctgttgcagggggtgtttccttgaactttcccatctgcttctaagcaagaggtataaaatattatctataaaataagactagcaaatgactcacagtgaataaaaataaatcagggtgtagtttgtcatcatctttaagagaaaaaaaaaggaaaatgctccacaattggagaaacaactcactttttcaaacctcctcaaggaacgtcttcaaatgataggcaggaaatgggtatgtgggggttaagttaagctcaagtaaactcaagtggcaagagcatgatccagccccatcatacatattcataagaggcaacctgagcttccgtgtaaaaccacagtgtgactgtatttcctgcacacactttgcatcccacacagcccggacacactgcagcactggaggggcacaatgccttgctttaaaacatggctcagaagaaccataattgttcattgacaacttaacctacacattgactggatgttctccataggccttatgacagctcaagaagtatctgtcaggatgcagtttgaaagacatcattgtgcaagtgtgaatctcaaggcttcggctgctaagaagcaaaaatggaatatggttatttgttttcaataaagcattgggcatttattactaatactctaatggagaaacaggtcagtctaaccaacatgggaagatgataacactctatatactgcttctcttctcaacagactttctacaacaaaatacccatagtttcagctgccagaaaatataaaccaaaggccttgtttcagtgggatttggggtggcatcgatagtatagtggtaaacataactgcttttcagtagaatttgggaaggcatgtactgggtttttcttcattcactcaacaaatatttattaagtgccacgatgtgccaagtactgccctgggcacttggaaaaaccacaatgaacaaaacacaaaagtccctgcatcatgaaggctatgatcgcggagtgtttcagactgccatgctcctccagagagaaagaacaccttatcatgtgcctgtcattaaagggcctggacctttttcttcaatttctttcaaatgccctcgatgactctgtcaatgaagtttgtatgtgtgcccatatgtgctgtttgaaagaaggaagagagagggaaagaaagcaacactgaaacacgattcaaaaagtgatagaaagatttacctttatgattgggaaagccacaaagacatgagtactgggaaacacaaaagaacactagtgcagatggaaaaatctatttgttttattaggaagatggaaaatattatcaagatgtcaactcttggccaggcacagtggttcacacctgtaatccagcactttgggagcccaaggcagatgtatcatctgaggtcaggagttcgagaccagcctgaccaacatggtgaaaccctgtctctactaaaaaaaaaatacaaaaaaattagcgggggggtttggtggcacatgcctgtaatcacagctacttgggaggctgaggcaggagaatcacttgaacctgggaggcagaggttgctgtgagctgagatcgcgccattgcactccagcctgggcaacgagggcgaaactctgtttcaaaaatgaaaaaagatgtcaactctcatgatttaagctataaatttgatatatgacaaaaaaattcataatggtcttgtgaactaagttgattcaaagcacaaagaaaaatctgagggggaaaagtctaatgagggaggaactagctctaccagatgctgaaatataaagctttgataactgaaagtgtatgctaactcataaatagacaaaacggtggaactgaatgaaacaccgggaaataattccaaatccatttgggaattaaatatctgatcaacatgccacattgcccataggtctgttgacctcagcagcattgtcagtcatgcagtgtggtccttcacctccttctcattaggaggcttggagctaaccagaggttgtgggttcaggagtaagaaagaacactgggcttagatggctagacaccagagcaccaatcttgctctaccacctgtaacttggtgaccttgtgttgagctttggtttcattgtctataatatgaggataatgaaatccattgccaagctttattgtggggataagtttatataatatatgaatctacctaacaaatatcaactatttaacaaaataaacatattctaattgaatagcttaacgggcatcttaactccaggttgacagtttcacaatttgtctgtctgcagacagaaattgctttttaaaaatctcaaatccttttttttttttttttgccattcaacatgtaaataagatttagaaaaaagaattattttaaagctcagatttagagtcaatgatttccttacagaggaaagtctttataaataagatcaagttgttgagtgggtggatgaaatccagcaagagaagtttcagttacatagcacaggaaaggatcttcttttttttttttttttttgagacggagtctcactctgttgcccgggctggagtgcagtggcatggtctcagctcactgcaagctccgcctcccgggttcacgccattctcctgcctcagcctcccgagtagctgagactacaggcgcctgccaccacgcccagctaatttttttgtgtttttagtagagatggggtttcaccatgttagccaggatggtctcgatctcctgacctcgtgatccgcccgcctcggcctcccaaagtgttgggattacaggcgtgagccaccgcgcccagcccaggaaaggatcttttaacttctgtgttttaaaggaagatgtggagctttttaaagatgacgctgcactaagcatgagctgatggaaacctgtcctgtgtgtagagagcacccaaggttcgggtgttgtgccaaaatggagaccttactcttggacaaaagaagcttgaacaatttatggtgagggtagaagtacaaacaaaattccatgtaattttttaatttccacctttggttatattgtacaattcagtgcctaagggatcaaaggatgttgaagagagttttgggaaatcacatatactcttgggaaacttcatgacaaagggcaatcttgggcagtgttggaaagggacgaagtggatcacttggtggaaagtggcaggcagaagagtatgtggatgcctcagaagtggatgtggttaaaggatggaacaatgaagggtttgatggctgcaataaggcgtacaagacaatgagatgagtaataagctgacagaatgcttgctgaataatcctgatttaaatttgtcaggcaagtgatgaaaagaatgtttgctgctggccaggatggtctgaccgagaaagctagacacaagagacaaataaggctatttccattgtctaactaacaatgcttaggtccaagctggtctgaacctgtgagaacagagacagtgcacagctttgaaaatcctgtaggacaaggaatcatggaattggtgatttttctggacaaaatgatagaggaaaaggtttaacaaggttaggatcatagaaagctgacaggaggatggagccattgtcaacaaagagaacttcagacctgctaagcgtttgtaaggagcacaaggagagaaaataaacccaattttggctgcatttggctgtggatgacaaccagcataacaacccaatctccatcagaaacggaatcaagactttaaatataataaattcagaattcttagcaaaaagaatattgtgctgtttcttttgttatggggctaaaattgttcccatttatgataggcacaaaatatacttatgaaagtcatgcttatcactgacctacatcttctgtaaggaaaatgtatgttacagacaccaagaagaagatctcacctcccaccttctctgtgatagagaaaatagcagaggagcacatttttgacaatcttgctaacaaggggaaacatttcatgcagtatcatcagctccacaatctgtcttactcccaagtccaccagctgctaaaataatgaattttctttaggtcatcattttggtcttttcttggatactggtcattgaaaaggtgagatgttattaggtcattgtgtgggctcccagatggatgtcagagatggggccatagctaattgtgatatgaatataggatttacataatcaatgcctatgtcacaatgtcccgtaagaaaatcaacatcattattttatcattcacacctcattttttataaatggattaattattcacccaattcaccaggtttggctttgaacaatcctcaggtttccctttcccccaggacatgtccttaaataaattgaagcatttttgtcacaatgtattatagttttaaacatatttagcagcagaacttttatttttctaatgagaacctcaagttattaaacagtcaatattcattaaggtctttctcaccttatttgaattttcagggattgatggaaattatgtcattctttgtgaacttctgaaaagcctatggaaatgaaggcaagtccaaaagagatcccagcatcttctgagcacccacagaagagtagagctgcccaatgtgactacatataagagccaatgttatatgctgtttgatatgcttttagaaacattaaccacaccttgtattacataaaagcaaaggctttagagtcggacaggcctgggtctgaatcttgctgtatgatcttcagcaggttacttagcctctccaagactcagttgaaacttctgtgaaatcgatataataatacagatcttaaaatgttgttatgaggggaaaacgatgtgatatgtgtaaagaactagcacaatgtctaatgtatagtaagtgctcaaaaatggtaggtaataattatactattggaaataataataattaccttaccttatagggtgtaatcaccagagtgtgtaagacagaactgcagagttagtaatgactaactgctagtttagttaatgagctaacggccagttcatacctggctagcgtgccacgaaatggaatttctaactcttctatcataaatagcatcagcaagtaagacactgaggagtcaaaatgccacctgggtatgtattagtccattctcacactactataaagaactgccagagactggataatctataaaggaaataggtttaattgactcacaattccacctggcttgggaggcctcaggaaacttacaatcatggcagaaggtgaaggggaagcaagtactttcttcacatggtgccaggagagagaactagcaagagcagggaaaactgccttataaaaccgtcaaatctcatgaaaactcactcactatcatgagaacagcatgggggaactgcccgcaccctcccccaccccgccccatgattcaattacctcccaccaggtccctccctctttatgtggggattatagggattacaattcaaaatgagatttgggtggggacacagccaaaccatatgaggatataaggctcttcaacgcatacttttagcagagtatctatgattttagtgagtagaccttgacagctaaataaagctatcttccttctgtcaggatcctgggaacttcttctatagatactcattgtcttattttaagaactgccagagaaacagattccacaacttcccttaataacctatttctgtgcttagtaattgttcctcttagtaaatcttctgagctaatctgaatcctttgtgctctaatttaaggccagtcatctcacatttaattcagatcttattgatacctgtatcactattgaaccaaattacaactagaaatattgacaaatgtgttatcacggagatttcagcatgagcatatgcatttgacaatcaactgtgatgagttaacatgccagagagtggtattgttcatgtaatcagagacacattagcagtgttctcttaaaggcacagccccagttcatctttgacaattgtcacacactgacttgtgtgacatgaatcagaaataagcagtattttaaaagccagcaaaatgaaaggaacaacatctaagttgttttcggcagagttttctgctgctctggccaagatgcatcccagagatttggttttcagggtgttggctcattctcgttatttattttattttattttattttactttactttacattttattttattttattttattttattttattttattttattttattttattttatttattttggagcagagtctcactctgtcacccaggctggagtacagtggtgtgagctcggctcactgcaacctctgcctcccaggttcaagtgattctcctgccttagcctcccgagtagctgggattacaggtgcctgccactacgcccggctaatttttgtatttttagtagagatggggtttcaccatattggccaggctggtctccaactcccgacctcaggtgatcctctcaccttggcctcccgaagtgctgggattgcaggtgtgagccaccacgcccagccaagctcattctctttaaaaggtaccacttcctggtctggtttttgggatggttcggctttttaagtcatgtccagaattaatcaatagcaaaaaaacccagccgggagcggtggctcacgcctgtaatcccagcactttgggaggccaaggtgggtggatcacaaggtcaggagattgagaccatcctggcttacacggtgaaaccccatctctactaaaaataaaaaaaaattagccgggtgtggtggcacatgcttgtagtcccagctactcgggaggctgaggcaggaaaatagcttgaacccgggaggcggagattgcagtgagccgagatcgtgccactgcgctccagcctgggcaacagagctgacttgaagaaaaacagaaaacaacaacaataacaaaaaacaataaatcagccgggcgcagtggctcgatcctgtaatcccatcaccctgggagtccgaggcgggtggatcatgaggtcaggagatcgagaccatcctggccaacatggtgaaacctcgtctctactaaaaatacaaaaattagctgggtgtgatggcatgcagctgtaattccagctacttgggaggcagaggcaggagaatcgcttgaacccgggaggcagagattgcagtgagccgagatcacgccactgcactccagcctggtgacagaatgagactgtctataaataaataaataaataaataaataaatcccttgaagcccacatccaggtgaaagtgacgtttctttctttatcttcatgtgtcagagaagtaccagtccaaataccactgcgttcaggagatttgaaaagcagtgctaaaaagggactcaagcggagccatcgcaggtgcccggccatctgcccagcaaagccaggcgtgccgccaaagaccctgcagcctttctgtgtagactaggtcggagttccagaagtgttttttgaacatgatcccttgggtactgtcgcccaccacaaagaaaaagtggttaaaacaaaatgttcagaggccgggcgcggtggctcacgcctgaaatcccagcactttgggaggctgaggcgggtggatcacgaggtcaggagattgagaccttcctggctaacagtgaaaccccgtctttactaaataaaatacaaaaaattagccaggcgtggtggcaggcgcctgtagtcccagctactcaggaggctgaggcaggagaatggcgtgaacccgggaggcggagcttgcagtgagccaagatcgcgccactgcactccagcctgggagacagagcgagactccgtctcaaaaaaaaaaaaaaaagttcagaaaacatagtatacagaggtggactgaccataaactgaggaggtataagatttattcatataggtcccattcaaagacttacacctaaggtatattcatgatttgtgttctcagaatcacatattcccggaccgctctgaaacccactttcctcttctgtagaacagcactgaatatacctcgcctgcacctagtgttccttatcttaaaagggccaccaatcccagcactttgggaggcagaggtgggaggatcatttgagcccaggaatttaagaccagcctgggcaacatggcaagacctcatctcatttttttaaaaaagggagagggcaccaaaatcagcttcgggacccccaaatctggatcccacacctgactttgggagtttgcttattaatctcattatgtcctaaagtaaagacttctgcctaatttcatgtaacctaatgtttcctcttgagtggtagtaggatagcactctctctttcctagtgagcagtctgtcacacaggaggaagatgacaggtgacagaggtcacagtagtcctcatatcacccagcttctcccagcccccacatgtccgcgtgcctttcccccagcccctgcctctctagatattctcttcttaaggacatttcatctggcaggtgagcaggtctcaaagttcccgtttcagttccccagacatcctttggaagtgagtgtcctttccagagcttttatgtcacctccttgtcactctcaattagaatctgctgggcattgcctgagctcccagaaagaactgggtcctttaggacataaagagaaatggaaaaggaaactaggaagaagagcagaggtgggtaagcgacattgtatttatgccaagggaacacaaaatgggtgtgagtataacacagaaccaggtgttcataaatttttgtatgggagtgaattggcatttttttcttagcattcaagttttaggagaagaaaggagaccctaagcttcttgtgaagaaaggactgccttctacccgccaggcctgttttggattcctgaaagagaagaaaggttgcagggttggacctggttagtacttggatgggagagagtagaaaggcttgttcttgggcttcccacctcccaccaaatgtatcctacgtacctcacctctacggagtgaccgtccaaaccttagagtagggacttggcgagaggtgggggcatagaagcctgtggcataaatggcaagtacggtctctctgtgtgatcagcatgggtcagtctcctccaaacatatgctttggaagtccctgttgtggtgaaaagagccctgcatggagttcagagggcatcttgagtcacagtcctgtcacttactgattcaaaacatgtgatggctgtgccatgatattttctattccacgtacttttatttcttttttttcttactgatcctggccatttcctggactcctctgagacccagtttctccctgttcataacaggatcgtgacacctgttcattccctgtgctcaattgttgttgcagctgagttcgtgatgagttgagagtctgggtcaaggacatggggtgttcagcaggcattaaacatgaacctcccaggggggctgagcattgtcagtccacctccccgcccatcgctcagaccaggtcttgtcacatttgcttccttcagctctgatttcacagctcagggtagctggaggtcacaaggcccctaggcacccacaagcctctgatgtccagcgtggttcatgtgtgcttttgccacaagtgcctgcagcggcatgaggcagctggaggtttggctcagtggatgcaagaaggaacacgaaagcagggttgttttggtttggggtttagattttctcccctttgttctttcactcaagaaagcatttgagtctgggcctatcttcctggctgatttcttgtcagagtctactatttttgttcttgtctcacatgactaatgttcttaatttcatttcactttaattttttccttttgaactctcatctcttcctcttctgatctgatctccttgctccacattcccatcctttcccccttttcagtcccctcaagtccttttgaaagcttccacacagataagcagattcatctttctcaatacagattaggggcagctcctctgagggggggaacccctccatgcaaacatctgcagttgccctgtgggcccctctggctcagactgtcttactataaaaatacatcttataccataagccaatgcacacgggtgtaggtagaattgcaacaatatttagcctcaaaacatgtgatggctgtgtcacaatattttctattccatatacttttatttcttttttctttattcttttcctccctctctcccttccttccctccttccttcctttttccctccttttcttctttcttttcctcctcttcttcctttcttcttcttcctctctctctctctttctctctccctcacccactaaactcatctcaggactcattagagtcattagtggattgtgacttgtactttgaaaaccactaatttaggagcactgtctacctgccctggggaaaaggccctttgctttgttttctgaaacacatattatctgtatataatgagaatccactccccaccaaacagatgaaatttaaatactcctggggtgaactgagaggtaaggacaaaatgacaacaggtctccaaattgtggagtcatcttggggttcaggaagttgggatgattgctctgatgctttgagcttccctagttcctcttattatgatgccccggtattttctagctacctctctcttctccccgaatccctgcaaagaaagttctaaggaaggaacttgtggtaagcagaataatggcccccaaagatgtccatgccatagtccccaaaacctgtgaatatgtttgagatgttaatggcaagaagaaattaaggccgaagatagaattagcattgctagtcagctgatcatgtaatggcaagaatatcctggtttatctagttaggaccaatgtaatcacaagggtccttataagtgaaggagggaggcagaacagtcaaggtcagagtgatgtgatatgaaactccagcagccattgctgactttgaagatggaaggggccacaaaccaaagaacgtgggcagcctttagaacctggaaaaagtgagaaaatggattctcccctacggcctccagaatggacagcaagactgccattaccttgactttagcccagtgagactcatgtcagactcctgacctccataaatgcaatacatttgcattttttgttttgtgttgttttgttttgttttgttttgtttttgagggagtctcgccttgtcgcccaggctggaatgcagtggtgcaatctcggctcactgcaacctctgctcccgggttcaagtgattcttgtgcctcagcctcccgaggagctgggactgactacaggtgcatgccaccacacctggctaatttttgtatttttggtagagatggggtttcatcatgttggccaggctggtcttgagctactgacttcaagtgatctgccctcctcagcctcccaaagtactgggattactggcatgagccaccgcacctcacatttgtgttgttttaagccaccaagtttgtggcagtatgtttcagcaacaataggaaactaacacagatgtgttattggtcaattacaacgcactatgaattagagcatttctgagtccaggggcatttttctttaaaatacctgatttttatcttccaaggctggttcgtggtattgtcctcagtctgggaaaggaagagaggtcggaggtctggcctcctgaacagttatgcagcctgccaacctgctgaactaccaagactcaggcagctgaccaaacgctggagaacagggtgggtagctgatgctgaggaaagtagggtttcctgtagggtggttctgcttcctactacgcagcaaacatcacaaaactgtccacctgcatattgtaattttacctaatggtttttttgtttgttttttgtttttgagacggagtctcactctgtcgcccaggctggagtgcagtggcacgatctcggctcactgcaagctccgcctcccaagttcatgccattctcctgcctcagcctcccaagtagctgggactacaggcgcccacgaccacacccggctaatttctttgtatttttagtagagacagagtttcaccgtgttaaccaggatggtctcgatctcctgacttcgtgatctgcccacctcggcctcccaaagtgctggtataacaggcgtgagccactgtaccgggccctgattttttttaattaaaggacaaaggcagtcactgtatctcaagggctaggctggctcatctaaaggaccccacaactgcattctggagcagaggtttcctagagctgacagttgtgaggacagcttcatgggacataatgatgggtgctgtggtgagccccacccagacggaccggagtcggttcattctcctttaacctcatcatggtcagatcctattcaatggccatcaggactgccattgcctgagcaattggtcttgagaaaagaacttcagctccctggacttcgtttcctcctcaataaaatgccatcactacccagttcagaggctctgacaacagcatccacagcagatacttccccaaagttcctgaaggagaagctctttctttgcaggtgtttcagattctctctctctctgtggtgaagcccaaggttttgcgcaccctcccctctggactcgaagtgtatgccatataaaattacatcatatttcataaacagagcactgttttgattttgggtctcctccctagggtcaatggcttctctctactcaggctccttctctctgggagtccaagtagaagcacacaacgtttgttgattacaccaaagaaatattagagatgggtgttttgccaagatttttccttccagaccagagcacgaagtgcttccacctcaaaatagcctttgtgttgtgggtttataaattctaacatgcattgtggtctttagggtgctagattctttactactaacagtcttgttatatttgagaagctgcttgtaatacaaacaagcctgaagttcagtgtctctagaatggatgactattttattgtgagtcatggttaactagttgatgagcctatggtcctcaccgccctaagccatgccctatgcaaccttgagccaatcctgactttatgcaggaggggtgtaaactttagccccacattctagaagtcaggctcagtcagcctagccagactacctctgtggaaagatctaataaccagcattctgagtgctaagaatgttgcttttgaacctgccaaatttcccagtcacttgaggctcagggccttgccttgctcttgctaatctcccctctggggatgaccatcctaaccataaactgcaaacaaccttccccaataacttctgccggcctaagtccttgttgtatcacagaatatcaacacccaccagaattccgtgttggaacaccctgcaaccttgcgatgaaccacacagtgctccgtgctgacttgtgggttagccctgccctgctacctgttctgaggattgcatattctcttggaatttattccctgatgcccatttccccagctcttccaaggctgcctgtcccactgtacgtatgcctggccatctcccaagatatgtcaacaactgatagatcaacactttaggagccagaacgtcttattagagtgaaatgttaattaggataggaactgttggaatgtagcagcaagcagagccatcaggttttgggcggtggagactgtgtaagcatcacattagggaattactctctgagcaaaacacaaaatgagatgcctcaaactgaagagaaaagaaatggttgctgattttacaaagcctggaaatttttaaatttatttctgctgttgtttttgtcactatatatttttaaattatttttattgtgacaaaataaacataaaatttaccatcttaaccatttttaagggtacagttcagtggtgtcaagtccgtatagtcacagtgttgtgcaatgtcaccaccatccatctctagaactctttttatcttggaaaactgaaactctgtatctattaaagaataaatctctatttctcttcttcccccagcccctggtaaccacagttctactttctgtctctctgaatctgactactctaggtacctcatgtaaatggaatcatatagtatttgccgttttgtgattggtttatttcacttaatgttcttaaggtttatccacattgtagcatgtcagaattttcttcctttttaaggctgaataattttttatatttatatatctttatatagagatatatagagaaaaattattcagcctaatatgaatatgtgtgtgtatatatatctctcaaattttgtttatccattcctctgtatatgaacgcttgagttgcttctaccttttggatattgtgactaatgctgctatgtctgcacatatgcaaatatctgttctaatctttactttcagttcttttgagtatgtgccagaagtgggattgctaagtaatacggtagttctatgtttagctttttgaggagctgccatgccattttccatagcagtggcacaagggttccaatttctccacatcctcttcaacagttgttattttctgggtttaattttttaatagtagccttcctaacgggtgtgaggtggtatctttttggttttttcataaatcttctgtaagtttccatcctctgaaaatatctgccagggaagatcttgtcatccccccttcccatagatgagtattgttcaagttaaaggatatcacctctttgtcctcactaatttgtagcttgataatatttttaacaataaacttttccatctatctatatctagagtttagtaaaggccttatcaatagctaaaattaactaaaggtttcaatatgagtatttgatgttatttattttcatggttttatttatatgaaagtagaaacaaatttgtcttgttgtgccttccttcagaatcccagaaaatttattttcaaatgtgatgacatattccatagggattcaaaaaacaaacaaacattttaaggtttctgagggcttttaaggaaataactaagtccttagaaatgtgacagagatcataattattaacaataataattacttacattattccactagaaagcattttaacaaataaagacatattcaaaaaattactagtgaaacatacctaaatcattttatataatctagtaagaacatagtgattaaaaatatttcatgtaatttatttcaactattaatttaaaacatcgatattaattctatgttatgcaaacaatttattttttaaaaccatgtgattgtggtttttaaaaaaggtcctaaattacataggagtaaaataaattatttttattttatatatatatatatatatattttttttttaagagatttggtcttgctctgtcacccaggctggagtgcagtggcacagtcgtggccactagaacttctgggctcaagggatcctcccacttcagcctcccaagtagctggaactacaggcaagcaccatcatgcccagctacttaaaacaattttttttatagagacagagtctcattctgttgaacaggttggtctcaaactcctggcctcaagtgattttcccaccccccagcaaatatattatattcatgaagtgattttaccattcttttatttctgatgcctttctggtttcacgtgaaacaaattctattccttaggcttagaatatttttccttctaaaattatttaaattctactcatctttcaaggccttgctcaggccttcctccactagaaggtaatcttcaggagggcagggattcttgtcggttttgtttaaggttctatgatcactacatagaagagtacccagcactaggaggtgctttatatatgtacattgaatacaagaacaaatgaatgagtgaataaatgaatgaatatcccagatcttatggcttactccctcctctaaacttctacagtatgtggactatctatataattcttttgactcttaacatgtacattttgtggcaggcatttgtgttgtcccagcatatgatagaatcacactttcccactcatttgacgttagatgtggttatgcacttgctttagataatgacaactgagcagaagcaacaagtgtaacatctaggaagaagctgtaagaacaactgggtgactcatgaccttccttttttcctccttcgatgattgtagaagctagtgtcagtagggcgcccccactagcttggcttccggagtgactacaatgactaaaacccccgtgccaacctgagatggtcatgtagtaagagtgcaaaaaaacctttctgttacaatcctctgaaatgtagtgattatttatttctggagcataacctggctgttcctgactagtacacacttttaagctgtatttatctgttaatttgtgtctccaactggatcccaaatcctgttgaaaaagtaactatatcttacagtcttttggttttcctttttccagtccaatgccttaaaccttatagattctttataaatgtttactgaccatcgccaccaccaatggtagtgatgatgatgacgacgaagatgacaataacatgaggtcattatcaggtgtacctagatttgaagcaaccactttggtctctgtgttctttattttatttatttatttattttgagatggagtctcactctgtcacccaggctggagtgcagtggcacgatctccacccactgcagcctccacctcccattttcaagcgattctcctgcctcagcctcccaagtagctgagattacaggcgccagccaccacactcagctaattgtcttgtatttttagtagagatggggttttaccatgttgaccaggctggttttgaactcctgacctcaagtgatccactcgcctcagcttcccaaagtgctaggactacgggtgtgagccaccatgcccagactgatttaaaaaaaaaaatgctcagttagaaacagaaacagactcaaatgtgccatggtttggggactcataaaatatgtacgttttgatcatacttcctttgtaccctcagaagttcaaacagaaacttatatgtaaataatactgagattctagtcatcttaatttttatgttaaatttgatcattagatacaaatcatcatttgagagcacgattaagaaggcacctcttgcttaaacatgcttttaatctgtcatacccctgctttaaaacatatttccttctttatcttgctttacaatgcccagcatagtctgggatattttgcgacctttagggtaactttgtcaagactgtctctgttccattttcagaaaaggaaacatccttttagcaaataaaaaacaaaagccatccttcaagtttggatttgagtgaccctacatggcttgcaactgacatggatggtgattcccctggaaatgaagtaggaattttttttttttttttttgagacagagggttgctctgttgcccaggctggagtgcaatggcgcgatcttggctcactgcaacttccgcctcccgggttcaagcaattctctgcctcagcctcccgagtagctgggattacaggcgcttgccaccacgcctggctaattttttgtatttttaatagagacagggtttcaccatcttggccaggctggccttgaactcctgacctcctgatccacccacctcagcctcccaaagtgctgagattataggcatgaaccaccgcgcccggccaggattttctatatcaagtcatttgtgtgtctttggacaaagattttaataatatttgccatatttttctataagaacaactgggctaaatctaatttacaattgaaaggcatgataattttactggggctacttcctcaagattacttaatcctagcaatttacaggacacctagagatggcaccacttaagagtgaaggagaagcaaggtcagtccttgtgtttgctcttccccggcgtgagctgtcaccacccctcctggcctctggttcacttaacagtcattgacacttttcaccctccgctctttctctacaactgctctattttcactctttctcacagtcccaggcctgatatttctccttccttctgaccttgaggaacctctcatcctttctcaaattacaatgcatatctcaacattgattccatatccctgttctcactttccctttccctgattgcttttgagagaagataattgaggtacgccactcagatatcgctatcttctgctgacactgaacatctcttcaaaaggatcaatgggcaaagtaattgttcagaataaagaccggaagacgtggcaaagatcacatagaggagagactgaaggctgagttcattctgtagaatctgactggtgaaggctgacatgaaattaattaccatcatgcaaagaggtggtcttacgaagctcacgagtgaagaaagtacaagtcccacttcctacccaacctccagatctctgcacgtgattttctaattcctatgccaattccctttccttttatattcctcacccttaattctctctttctctcgttcacaatgcatgagcacatccaagctctctactttggaaatacactttagaaaaatacacttttcagcacctccaccattcccaccctagtccaaacagccataatatctgacctgaactatgcgataacctccaaactagtctctttgcttctctacatttgtctccttgttctattctcaacacaacagccagaatggtcttttaaaaacagaagtcacataatgtcactcctttgctcaaacagtacatttacagctcccaagaacgaaatctcaagccctaatggaggttccaaggctttccattctctgtcctctgatgcttttctgatctcatctcctactactccattccagcctcactgacctccttgctgctccttgagcatttcatgtaagctcctgttttaagcctttgcgggcactatttcctctgcttagaaaggtgcttcgctagatacccacacaaattgttgtccaaattagctaagcaactgtaacaaaatacagtgattaaattcaagaccagaattttatttctctctcatgtaaaggtggagatggcaggtcagctctgccgtcctcagtatgtggtagcctagattgatccagttatcaccatatcccagttagcaggaagaagacatgtgcctttaaggagatgacctaaaagttgcacaccacttttgttcacattcaaattggttcaaacttagtctgcagcacacgtagctgcaaggagagctgggaaatgtagtcaggagctgtcattcatttgcttagtaaaaactctgaaggctctatcaataaaaacaataagaggaaaaaggatgctggagggtagtggcagtctctgctgtagcccttccctaattcaggacgctgctcagataatattcttatcagaaaaacctccccttttcgcctttctgaaaatatcctttcactgtaactctctatccctttactctggtttttatttgttcctggtaattgataaagcatagcattttttgtgcattcactgcttcccctcacaagaatgtagacaccagacaccttgaaggcagggatttcacttcattcactgctgtatccccaagtgtctgcagcagtgcttgatacagtaggcatttaaaaatatttgttgaatgggctgggcatggtggctcacgcctgtagtcccagcacattgggaagccaaggtgggcagatcatttgaggtcaggagttcaagaccagcttggccaatatggtgaaacgctgtttctactaaaaataccaaaaaaaaaaaaaaaaaaaattaactgggcgtggtggcatgcgcctgtagtcccagctactcagtaggctgaagcaggagaattgcttgaacctgggagacagaggttgcagtgagccaagatcgtgccactgcactccagcctgagcaacacaatgagactctgtcttaaaaataaataaatgaaaataaataaaataaaaatatttgttgaatgaatacataaatatgtgttggatcacatttggggttcaataagtatgaaatggagtatggaggagacaggattttaatttattctcaaaagctggaggaataccagttaaagatttctgtctctaatacatttcctttcattggaaataattaatgggccctttatttcttacaaatatggagcaaaaatgcacacattgttttgggaaaaatataaaatcatcattgaactaaggctattgcaacctgacttattaaaagttctgcacagtaataaaaactaagtgtacatttcatgagactttgctctcatcaagttaaagaggggtgttaggaaatgttgggcttaaattggactgtccttgaagattcctgttgtttcctgaagttatttgcatgtcctggttccaaatatgtcccacaggaggtatgcgacctgggccacggcaggagggagcagtgcctgccatgccgtcaccctaagcttcacctaaagctgaggaaggccatgtggggtgggccaggcctggaccagggctctccagatttcacaacaatgtcccccacaaggtgatatttaagtctgggaaacatataaccaaccattttagtgccttgtctgggccatgaaggaagcctatccaagcatgcgggttaagtctactcaagagaaatgtcaaccaacctagtgtgagaacttctcgtcctgggactggactccaagggaggtagatacctggccatggttttcagtgggggttgacctggcctcgccatgtggaagcctgatggaagtttcctctcaaatccctttgctctgagactggatctgggtgcatgaccccagaagctcccttccggcagcagtgcatgctgcttcttatgctggaggtctgtttgtcccaccacagcctggtcttggctgagttgtgaggactaaagggagtaaccagagttcctgctcagagcaacaggtacaggggtacaggcagcctgacaagccagatgcaggatggactggaggatttgtggagctccagaaagctggggttctatagatacaccttcctccaggatgcccaaaaaccacctgagaggtgagaccggtaggaaaattggctttctgtggcctatgaaagggagctttattgtaacttaaatactaaaaggagaatgctgttgtttataagtcacaagctggtgagatctaaggatctgtcaatcacatctaattgggaatattgagagaaggagttgtagctcttgtttatgacatcacaacattttcctaattatcttaagcagcatcacagctttcttaaacgtttctcagaaaaaaagattctaaaagctaacgtcatactgtacctattaggagaaaggagaccgataaacaaactagagcatacagcttgctccatcagaaacaaattagtcttccttggatacgactttcactgtttcacctttctgtgccaaaacagtcaatggccccctgctccctctaatatctggctgatattccactgtttgatttttcctttgcagagaaacctttcctaaacactgaacttacttctactttctcccatcataagctgtccacccaagggtctgccaggctccccattcatcctggcccctgcttttgctcattcattcacttcacttagaaccgcatgctgaacaatttatccccaatctagccactgtcttgaattgtgtgctgttttacatctgcagtcatgtgccacaaaacatctcagtcaatgacagagcatatgtatgataatggtcccataacattataataccatatttttactatacattttctatagtcagatatataaatacttaccattgtgttacagttgcctacagtatttagtacagtaacatcatgtgtaggtttgtagcctaggcgcaatgggttataccatatggcctacgtgtatagtaggctctaccacctaggttcgtctaagtatatactctatgatcttagtataatcacaaaattgcccaatgacgcatttcccagaatgcacccccatcattaagtgatgcatgactgttttgttttgattcttcaactagatgacaaacccctctaggaggtaatttcttttatgtttctcactgcacctagcaccattccaggcacctcatgggactcaattaacacatttttattaaacgcttgaagaaaaggctgggaatcactgacctatagataattcttataatcaagtgtccttcttcccaattacatgaagagtctgtgttggtctcctaatgccactgtaacaaattctcacaaacttggcggcttaaaagcaacagaaatgtattctctcatagtcctagaggcagaaatccgagatcagtttcacagggctgaaataaaggtgtcaagagcctccctccctccggaggctctagaggagaattcactccttgcctctcccagtttctagctgctgtcggcatcccctggcttggggctgcatcttactgatctctgctttcgtggtcctgttgtcttctcctcgtcagtgtgtcgtctccctctacctctatattataaggacacttgtgattaaatttaaggccctcctggataatccaagataatctccccacctcaaaatcctttatttaatcacatctgccaagacctttttgcctccaggtaaggcaacgtttacaggttccagagattagaacttgatatcttattcagtctactacaagttataatttaaataacatccttaatatttgttcaaataaacataataccaatagaaaaggataatgtagacctagaaatgaagaaatgcagttcttggctgggcatggtggctcatgcctgtaattctagcactttgggaggtcgaggtgggcggatcacttgaggtcaggagttcaaaaccagcctggccaacatggtgaaaccccatctctactaaaaatacaacaaatttgccgggcgtggtggtgcaggcttgtaatcccagctactcaggaggctgaggcaggagaatcgcttgaacccgggagatggaggttaaagtgagccaagatcgcactactgcactccagcctgggagatggagtgagattctgtctcaaaaaaaaaagaaagaaaaaagaaatgcagttctcaatgaagtgatgaccagtctacacacacacacacacacacacacaccaacatatatacacctgtatgtccatgcatacgcaaatttgtgtatcagcaaaagtagttcctattgcatagacctattgcatagttttactatggaccaaggtcttatttgtaaaaaaaaaaaaaaaaaaaaagcaaaacagaattaaaaggcgtatctctgggcattcaattgagactaccaaaatgacaaaaagaaaggctagattctatagaaagggagatttgtttacaactaaagtatttcaaaagtttaccaaataaaaatagtaacttttaaggttaatatgggttaaagaattattgggacaagtagcctgagtgataagacataatttaatttgcaaatgtttctatcaaataatgatctcactccactacttccttctaaatcacaggaggaattaagaaacaatgtgagatctaattacaatgcccaatatttgtataacagtttatggtttacaaagttctttttcttttctttttttttttttttttgagatggcgtctcactctatcgcccagggtggagttcagtggtgtgatctcggctcacttccacctctgtcgcccaggttcaagcaattcccctgcctcagcctcccgagtagctgggattacaggcacctggcactgcacccagctgatttttgtatctttagtagagacggggtttcaccatcttggctaggctggtcttgaactactgacctcgtgatccacccgcctcgtcctcccaaagtgctgggattacaggcatgagccaccgtgcccagcgatttacaaagctcttgacatacctgttctcatttgattcttaccacaatttggtgaaataggcagagtgtgtattcttactcccagtttgcagatgaacaaattgatttagagagagtcaatgactttctcaagaaaacctagctaataattgtcaggtgttaacaacaactcaggcttcctacttctcaattcagtacactctcaagataagaataaccgtaatgcatttaattgttaattgagaaattagtaaattgacatctaagagagacagctctggcttatgagctgcttgtcctgctgaagccctggcagccactgactctaccaatctggctcctccatgtttgtctgttctacctctgaactggcgctaaacttaatccagatctgaggatattcctgacatataaaaatactggcagcaaggtcaacaatctggttcttattttggttctgtagcttggtttaatgagcaaatcttggaaactaaccttcaattaatcaaacagtattattgatcccaaaatatgtgtaagacattgtgtcagaaaagcattcatcatccactcacccatctacctgtccatccatccatccatttatcctgttattattaactgattatctactacagccaggcactcgaatcaaagatgaacaaaatgcagttgctgttactaagtttctcacagttcagtgagggggagacacatattagatcagtaaaaataagataaattaaatccaacattggagttatattcagagtattactgaggttgggaaagcattcctggaagtatatctaaaatgcaccctttaagaacaaatgaagttagcagggggaggaagagtaagtggtagggaggagggtggagcagaagacacagaaacaaaggctcagagccaagagacagcacggtgtgcattagctgtgcgtctggatcaagatacctaaaacctagaagcctatctttcatcctacttccactgcaggctccccagtgagtgccacagtctcaggaggtacactgggcaaggccattttattagtggcagggtctactacagtagtgctttaggctgataagctgtgcggaaccatgcatgcgagtttgcagccctgctttaagtggagggaaggaaagggagaatctggtttctcatattccagggtggaatgtgagcccaggttggaatatgagcctcagggtgagcgagtgattcaagagcatcaacaaaaacccaaaggaagaatccatggctaaggggaagatccagaaaaatccttcaggagggcacaagaatttttaatgtgcaacctttcaccctctaactcagcactctagttgctcgtcctggacccttctcagcgttcctttcctctccctggtgggatgaggctgtggatggaggagagtatgacccctagtggctggagtgcaactctaattgatatggggggtctgggctttgggggacaggacctgactgtatttacagagcctagaatgggaagcagggtgtggtaagcagtgagcctggagcaggagggagtggtgagatcagggcctttaataccattttaagtagtctagagcagtgcttccccaaagaaatagaatgcaagccacacatgtgctttacaattttgcaacagagatatttaaaaaacagcaaattaccaaaaaggtaaaataaattttaataatgtattttaataaaccatatatgtcccaaagtttacctgttcaacacataatatgtattaaaaataattggtgataggttttacaaacttttattatactaagtgttctaaatctgagtattttacccttacagcacatctcagttctgactggccacatttcaagtactcaatagtcacatgcagctagtggctaccctattggacagcgtagatctagaacttttcctgaatgtacatggggttgtggaagggttttaggcatggccgtggaagaccagatgtgtattccacacacatcactatggtggatttgaggaaggtagacttcctggaggcaggaagatgaggtaggaaatgatgatatgaaagtgtaggtgagggggctgggcgcggtggctcacgcctgtaatcccagcactttgggaggcagacgcaggcagatcacaaggttaggagatcgagaccatcctggctaacacggtgaaaccccgtctctactaaaaatacaaaaaattagccgggcgtggtggcgggcgcctgtagtcccagctactcgggaggctgaggcaggagaatggcgtaaacccgggaggcggagcttgcagtgagccgaggtggcgccagtgcagtccagcctgggggacagagggaaactctgtgtcaaaaaaaaaaaaaagaagaaaagaaagtgtaggtgaggggtgcccagggtctgaatcaggaggtagggaggtgatagtgagtgtaagaggggaatgtaagttagaaaaacggaaaccaccctgggtgtttcaaagagaggaaaattaatgtggtgaattgctcatctagtgatgaaactgatgaaaagccaaagagagagaaatacagcaatttggaggatagcaaaagcaggaagcactgctgtccctaagctggaaggaaaagggaagaggtagagtcactggagccagaggctggggctggctggtatgagctacaactatggtggggccggctggcacgaggaaagaagagcagtcctggggaagacgccatcagaggcagagaagggaaggagaaataccctggccttccccctcttcccaccttccagccttccaacagtgcttcccattgccaaacctacctggaaggcagttgacaagggaaacgtaccttcctacaatgcagggggaatcgctctgagggcaaacaggcaagcaacaagtacaaggcaagcaacaagggtacggagacaaatgtttaaaacttttaagaggcaagctggcataagtcaaagactgatggtaacaaagaaaggagtcaaagtgaccactggccttcccagacacagcatttccaagacagccttatctgtccatccattcctcccttagggtgggtcctttcccaggaggacttgcaatcccttgtgtgaacaaggtttggaagctcaccagattcaagacatgtctaacgcccagcaggcgctcacattagacatcccactacgctggctttgttgacaaggtggatggggatgctgcagataagagacccagaggaggagcagatctggggataagactgagggtttagtgttagaaatgttgaactgaggcacttatagaacaccaaggaaagatggccagcagatatttggatatttgagctgaaattccagggagaggtcatggctgaatagataatttaggagtcctcagcacccaggagtatccaaaacataaatttgatgagattactcagagagaacatgtagaatgagaagagacgctaatgaggaagaaaccctaagaagagcaaaacacaagagtgctgagagcagaggtgtttctggccaagaggggtggagagagaaagaggagaactaggagggtgccaggctctctgaagcccaggagtggactctttagtgagtcttaaaaaagaactccctcatttattcattcaaccaatactctggacacagcagtaaaaaacacaaaaatccctgctcagatatgatttacatgttcatgtcactgcagcaaagaggtccatataaacaaagaaggaatagggtttatatgattgaaaatcagaacagctttggtgaaaaacgagtgcaattccaacagtgataagctcagaaaacagatcactgtgtgctgagcaaatgatgggcaaaggagtagagatgctaggtgcaaacaaatcttttgagaagttgtataaaaaggaaggagcaacagagcatatgatagaagtagcggaggttcaaatgaatgttcattttctttagctaagacagccttgctagtactcttgcatgtatatatgggctagctgctaggcaaaaggagtcaggaaagatgaggaagctgaagatttgaagagaacatacttgatggagccagattctgatgcaaataggaggtgaggtcctcaaaaggtcttgtaaattaagaacagctgtccaggtgtggtggctcggcactttgggaggctgaggggagcggatcccttgagcccaggagttcaagaccagcctgggcaacatggcgaaaccccgtctctactgaaaatacaaataattagctgggtgtggtggtgcaagcctgtagttccagctacttgggaagctgatgtgggagaatcacctgagcccaggggatagaggctgcagtggggcatgattgtgtcactacactccagcctggcagacaagaatgagaccctgtctcaaaaaaaaaaaaaaaaaaaaaaaaaaaaaaaaaaaagaatagctgaatgggtatgcatttaggagaaaattttttttactgttctttttttttttttttctagcaaccaccaaaataacaaacaaattcaaaaccaacctaagggtaggatatgtgcttcactcagggtgttctataaggggacaaagagagaagcctttccccctcctcctccactcctgcactctctacctggtcttgcctccataatatcttagtagctaaaacaggacccagcatgactttcccagcccattcagcaccatgactctccagaggccctgatatgcaaaatttcccaggcagcagaagtgctcgggattctggaaacagccagtcctggggatcccagtgtacagctggggatgtgggggaccagttagcatctggccaccactgagtgtagaaggggaggcactcctatgagtgtcccaccctgggctgctcacggggctgcggacaaagccaattcccaggttctaggacatccttccctaaaggagagacctcaggctagtgtgggaagatgtatagggaacacaaagaaggtgcaggctaatctcccattccagctcctctgcctactctgctccactgtctcaccacacctttctacgtgaagatagaactgattttaaagaacggatgtagggtgagtttatcttcagtgaccgcactgaaagcccttccaagccaggcccagcctggcccatgccctaggtcctccctaattggaccacagggcagagagacagtggagggagcctcccttgctggcttttctgggaccaacacagcggtgtgtgctcgctccatgcaaggtcattgtcacacatgctcagtgagttctccaggacacatctatgcaatgatttccttcctgagagagtcgtcaaaacaaatcccatcttcctgtgatgtcagcttcttcccacacacctgcagtcacaggccaagtcccaaaatgatgactgtctaaaagaatatacagaagtaataacaataaaaaaatctctaaagggccaatcaaggagaaaggctagtggtgcatgcatgcatatgtatatatctgcgtctatgtttgtatatatgcatatatgtatacacagatattctcacaaacatatacattctaaacaataaatgtgcaccaataataattaatttcattcagaaattatttcagaaaataattccattcaactgcttacctacataaaacagaatagaagatggtagtttgggctttaaaaaattacttctaatgcagtttgtttacaattataaaataaccagatggaaagcagtctggggaaaaaatctgtttcatcactggagtgaacaaacacaattagaatgctaaaaacaataagtctcatgaaaatgaacagagcaaggacttttttcttgaatagtgtttggatgaattacggccacctaaactccagtaatctcttgagactcagtaacccctatggcaccagctgcaggcaaaagaaaaagagctggctaatttgaaatcgaccattaacattcatttttttctcttgctaccattgtagcaactgtggtctgtcatctttgccttccatgtggcattgcatttcatgtgaagaaagcaagattggcaagcttccatctccttccctcactcattcattttctgcttagaagaaaaaaaaaaacaacaagttatcttcaagtgactttgagtaacctgagctaagacaattagaaatccatttattattaatgtgcattttttcttttttttttggcatgtgaagattttaagtaaaagagcacgttttattgtttgtgctacaagtactgagagtatctaaaaagaaaaccatagaataattt

SEQ ID NO: 701 - DNA, 88964 bp, Homo sapiens
cccctaagggtcttaagattaagtttcctttccacagttaaactttgttcatcagtaagacttttcaaatccatatctttcatttacattttagggttttttttacacgatgctcctctgtgatagcattattttaaaatattttgtattttattttattattttaaaagacacagtgggtcacgcctataatcctagcactttgggaggctgaggtaggaagatctcttgaggccaggagtttgagaccagctggggcaacacagtgagactctgtctgtaccaaaggaaaaaaaaattagccaggtgtggtagctcacatctagtagtcccagctactcaggaggcagaggcaggaggattgtttgagctcaggaattcaaggttacaatgaactatgatcatgccactgcactccagcaagagtgacagagtgagaccctgtctgtaaaagaatatttttgggcatgcttccaagatggccgaatagaaacagctccggtctgcagctcccagcgagatccacgcagaagacggatgatttctgcatttccagctgaggtatctggtgcacctcactgggactggttggacagtgggtgcagcccacagagggcgagctgaagcagggtagggcatcgcctcacccaggaagtgcaaggggtcaggggatttccctttccaagccaagggaagccatgacagactgtacctgggaaaacggtacatgcctgaccaaatactgagcttttcccacagtcttcgcaacctgcagaccaggagataccctccctcccatgcctggctcggtgagtcccacacccatggagccttactcactgctagcgcagcagtctgagatcgacctgcgacactgcagattggcggggggaggggcatctgccattgctgaggcttgagtagctcacagtgtaaacaaagaggccaggaagcacaaactgggcggagcccaccacagctcagcaaggcctactgcctctatagattccacctctggggacagggcatagtagaacaaaaggcagcagacagcttctgcagacttaaacgtccctgtctgacagctctgaagagagcagtgattctctcagcacggcgttcaagctctgagaatggacagactgcctcctcaagcaggtccctgacccccatgtagcctgactgggaaacatctcccagtaggggctgatagacacctcaaacaggcgggtgcccctctgggacgaagcttccagaggaaggatcaggcagcaatatttgctgttctgcagcctccactggtgatacataggcaaacaaggtctggagtggacctccagcaaactccaacagactggcagctcaggggtctgactgttaaaggaaaactaacaaacagaaaggaatatcatgaacatcaacaaaaatgacatccacaccaaaaccccatctgtaggtcaccaacatcaaagaccaaaggtagataaaaccacaaagatggggagaaaccagagcagaaaagctgaaaattccaaaagacacagggcctattctcttccaaaggatcgcagctcctcgccagcaaggggacaaaactggatggagaatgagtttgacaagttgacagaagtaggcttcagaaggtgggtaataacaaacttctctgagctaaaggagcatgttctaacccatcccaaggaagctaaaaatcttgaaaaaagattagatgaatggctaactagaatgaatagtgtagagaagaccttaaatgacctgatggagctgaaaaccatggcatgagaacttcatgatgcatgcataagcttcaatagctgattccatcaagtggaagaaaggatatcagtgattgaagatcaaattaatgaaataaagcaagaagacaagattagagaaaaaagagtgaaaagaaatgaacaaagcctccaagaaatatgggactaggtgaaaagaccaaataaatatacatttgattggtgtactggaaagtgacagggagaatgcaatcaagttagaaaacactcttcaggatattatccaggaaaacttccctaacctagcaaggcaggccaacattcaaattcaggaaacacagacaccaacacaaagatacgccttgagaagagcaactccaagacacataattgtcagattcaccaaggttgaaatgagggaaaaaatgttaagggcagccagagagaaagattgggttacccacaaagggaagcacatcagactaacaggggatctctcggcggaaaccttataagccagaagagagtgggggccaatattcaacattcttaaagaaaagaattttcaacccagaatctcatatccagtcaaactaagtttcataagtgaaggagaaataaaatcctttacagacaagtaaatgctgagagattttgtcaccaccaggcctgcattacaagagctcctggtggaagcactaaatatggaaaggaacaaccggtaccagccactgtaaaaacattccaaatggtaaagaccatcgatgctatgaagaaactgcatcaattaacaggcaaaataaccagctaatataataacaggatcaaattcaaacataacaatattaactttaaatgtaaatgggctaaatgccccaattaaaagacacaaactggcatactggataaagagtcaagacccatcagtgtgttgtattcaggagacccatctcatgtgcaaagatgcacataagctcaaaataaagggatggaggaatacttaccaagcaaatggaaagcaaaaaaaagcaggggttgcaatcctagtctctgataaaacagactttaaaccaacagagatcaaaaagagacaaagaaggccactacatattggtaaagggatcaattcaccaagaagagctaactatcctaaatatatatgcacccaatacaggagcacccagattcataaagcaagtccttagagacctacaaagagacttagactcccacaccataataatgggagactttaacaccccactgtcaacattagacagatcaatgagacagaaggttaacaaggatatccaggacttgaactcagctctggaccaaggagacctaatagacatctaagaactccacaccccaaatcaacagaatatacactcttctgagcatcacgtcgcacttattctaaaattgaccacataattggtagtaaaacactcctcaccagatgtaaaagaacagaaatcacaaaaaactgtctcgcagaccacagtgcaatcaaattagtactcaggattaataaactcactcaaaactgtacaactacatggaaactgaacaacctgctcctgaatgactcctggctaaataaataataaaattaaggcagaaataaacatgttctttgaaaccaaggagaacaaagacacaatgtaccagaatctctgggacatatttaaagaagtgtgtagagggaaattgatagcactaaatgcccacaagagaaagcaggaaagatctaaaatcgacaccctaaaatcacaattaaaagaactagagaagcaagagcaaacacattcaaaagctagcagaaggcaagaaataactaagattagagcagaactgaaggagagagtcacaaaaaacccttcgaaaaaccaatgtatccaggagctggttttttgaaaagaccaacaaattgatagaccgatagcaagactaataaagaagaaaagagagaagaatcaaatagatacaataaaaaatgataaaggggttataaccaccgatcccacagaaatacaaactaccatcagagaatactgtaaacacctctatgcaaataaactagaaaatctagaagaaatggacaaattcctggacacatacaccctcccaagactaaatcaggaagaagttgaatctctgaatagaccaaaaacaggttctgaaattgaagcaataatagcctaccaaccaaaaaaagaccaggaccagacggattcacagccaaattccaccagaagtacaaacaggagctggtaccattccttctgaaattatttcaatcaatagaaaaagagagaatcttccctaactctttttatgaggctagcatcatcctgatacaaaagcctgatagagacaaaactaaaaaagagaattttaggccaatatccctgatgaacatcaatgtgaaaatccttaataaaatactggaaaactgaatccagcagcacatcaaaaagcttatccaccacaatcaagttggcttcatccctgggatgcaaggctggttcaacatatgcaaatcaataaacataatccatcacataaacagaaccaatgacaaaaaccacatgattatctcaatagatgtagaaaagacctttgacaaaattcaacagcccttcatgctaaaaactctcaataaactaggtattgatggaacatatctcaaaataataagagctatttatgacaaacccacagccaatatcctactgaatgggcaaaaactagaagcattccctttgaaaactggcacaagacaaggatgccctctctcaatactcctattcaacatagttttggaagttcttctggctaggcaatcaggcaagagaaagacataaagggtattcaattaggaaaagaggaagtcaaattgtctctttgcagatgacacgactgtatatttagaaaaacccattgtctcagcccaaaatctccttaagctgataagcaacttcagcaaagtctcaggatacaaaatcaatgtgcaaaaatcacaagcattcctatacaccaataatagacaaacagagagccaaatcatgagtgaactcccattcacaattgcttcaaagagaataaaatacctaggaatccaacttacaagggatgtgaaggacctcttcaaggagaactacaaactactgctcaacacaataaaagaggacacaaacaaatggaagaacattccatgctcatggataggaagaatcagtatcatgaaaatggccatacaacccaaggtaatttatagattcaatgctatccccatcaagctaccactgactttcttcacagaattggaaaaaactactttaaagttcatatggaaccaaaaaaaagcccacatagccaaggcagtcttaagcaaaaagaacaaagctggaggcatcatggagacttcaaactatactacaaggctacagtaaccaaaacagcatggtactggtaccaaaacagatatatagaccaatggaacagaatagagacctcagaaataacacaacacatctacaaccatctgatctttgacaaatctgagaaaaacaagcaatggggaaagagttctctatttaataaattgtgctgaaaaaactggctagccaagtgtagaaagctgaaactggatcccttccttacaccatatacaaaaattaactcaagatgcattaaagacttaaatgtaagacctaacaccataaaaaccctagaagaaaacctaagcaataccattcaggacataggcatgggcaaagacttcatgattaaaacaccaaaagcaatggcaacaaaagccaaaatagacacatgagatctaattaaactaaagagcttctgctcagcaaaagaaactatcatcagagtgaacaggcaacctgtagaatgggagagaatctttgcaatctactcatctgacaaagggctaatatccagaatctacaaagaacttaaacaaatttacaagaaaaaaacaaacaaccatatcaaaaagtgggcaaaggatatgaacagacacttctcaaaagaagacatttatgcagccaacaaacatatgaaaaaaagctcatcatcactggtcatcagagaaatgcaaatcaaaaccacaatgagataccatctcatgcccattagaatggagatcattaagaagtcaggaaacaacagatgctggagaggatgtggagaaacaggaatgcttttacactgttggcgggagtgtaaattagttcaactgttgtggaagacagtgtggtgattcctcaaggatctagaactagaaatacataccatttgacccagcaatcccattactgggtatatacccaaaggattataagtcatgctactataaagacacatgcacacgtatgtttattatggcacctccgtcgccgaggccggagtctaatggcatgatctcagctcactgcaacctcagccttcagggtctgggcaattctcctgcctcagcctcccaagtagctgggattacaggtgtgtgctaccatgcccaactaatttttttgcatttttagtaaagacagggtttcaccatgttggccaggctggtcttgaactcctgacctcaggtgatccacctgccttggcctcccaaagtgctgggattacaggtgtgagccactgcacccaacctgaatatacacatcttaaaagcaaaaagaattgcataatcttcttaaactgcattcagtagtctttttgttagtggttctatggtaatgttattcggaaatcattatatgcacattgtaggatacaattaatacagaatgatattaagatctctaggagtcaagattcattaaaagtgggtcaaccagatcatgtgtgcctccagatgtgatgcactaggaaaaacacaacacctctatgcaatattattgtccacacaaaatgttggtaggggggaacctgaatgaaatcaagcatctagatttaactaccagcttgcatgaaatacgggaaacagagtaagtaaaatgacactagaggaagcattgagaacctgggacattttacaagacaaattacccgtttccttcaataaataagtcgcatgcagaaaaaataagacaaggagaattcttgtccattacaagagatgttagataaataacaaccaagtgcaatatgtagactctgtatgaattctgatttgaacacagccacatgtaaaaagacatttttgagacaatctgggaaactaaaatatagaatatgaatctgaatataatcaggactagatgacattcaggaattattgttatttattcataagacagtggcactgtgtttctattctctaaaaatataatctcctattagagatgcacactacagtataatataatttctgggatttgctttctaatactccagcaaaaatggaggaagagagaataaattaacaagattggcaaaatgctgattattgttcaagttagatgatgagtgatcattatggtattccttctacttctgtgttatattaaaatgtttccataataaaaagattttttaaattttatatatgctttctcttgtagttagaaggcccatctggagatttcatttcctaagaaatgagaaccaagtctgtgaagttcatttcctccttacaatggttgattctttcatcttggaatgcttgaaacaatgaaattgtctttccttctactattatgagagcagttcctactttttctttactatttggcttactcacagtttcctgtattcactcgtctttaagtagagacatatttatcctttataaataggcaatgataaaagaaaaacttcagccgaattaaatgtaaaggaatttaattgagcaatgaataatttgtgaattgggcagcccccagaatcacagcagattcagagagactccagtgcagccacatggtggaagaagattaatagacacaaaaagggaaatgatgtgcagaaattggaagtgaggtacacaacagctggactggttacagattggtgtttgccttatttgaacacagtttgaacactcagcagtgtatgaatggttgaagtatggctgctgggattggccaagactcagctattgatacacgtgcatactcctagttaggttttcaatcttgtctatctattaagctaggttgcagttcgtccacaaagactcaaatatagaaacagggaatccttctcaggccacatttagttcactttaacaacttcccccttttggtcattttctcaattttgagagattgaccaaaactttaattatcaatgtcactatcaccattgtaaaagtacttatttggtcttgaaacatactgggaaacagtagaacattgagttttgcaaaggtaaaaacaagtatgagtagagggaccctttatgggtacctctttatgctggaatgtcctatttacaggagaaaaacaaaacctggtctgttctaggatctatgtgtttccgtaaagtcttagtttgattatgtcacatttagcataagtgaccccattttagtttggtttggcctgttggggcctagtgaatgagcttagtccaaaacagtggcctcccacaactttgtttaaaaaagattcccccctttttggtcaggttctcacttaggtgaaagtgtgaccaaaacttagggccttagtgccactctcagttaccatcattttgggtttccagtctcaccacgtcattcataggttatagtaatctcatggtcgcacatttctttcagctcgtctttccatttgaagagagaccatttgacattctagaggtggctgcatgcaagatttaaaaccttcgagagaatacagtgcaccagggagactattattatgactctcaggaggataataccaagagtttagagtatgctccttacccagggtacccataaaccgaaccacctaaaattaaatagattaaagaatgagctggataaagagtctacttgctttaagtggtcttttcattaatcatctacaactgaatttttataatctacgtttgatgtatttctccataggccacaagtgtcagaagctgcacaggtacttttctgtttagccaattatattatttagcataactttcacaagagaatttaaagtctgttgtgtaacaataggctttacattagaatctgctatacagcctatcatgagggatacatttctaattattgcctcttttattctaaaccatggaaaaaggacctaacaaatgatgtccttctagaagagtgaaggcctcctggcaatgttctatttaacccatgatgtgggctaagaggagttttgactgattatgaggcgacatatataccattaaagtttctcacctatgttgggccttcatcttttatccatcaaagtataaagttattcatgtataaggctggtgcaaaatccttcacgaataaaagtataccctataagtgcacataatagaccccctcatcatttctattggctacagaggcataaataaggaaaaaatattcaaagataagagtctcacaatagtagatgtcttgatctgtgatctcgggaaaagctgtttacatcaaggatgccatcttattctggggagaaactttcctggttagttttaccttaagggttccaatgggtgtacagttccaatagtgtggagggacccttctcagttgtgagattatgaacttaaagttcaaggttccaaagttttgttgcagtgtggatggcaagcacagtctttctctgatgttctcaaaagatccagtctttaggttctagactgtgaagcagttgattatcctcggtgaaccataaaaactttctttacctggtgaaaatatactgtggcgtaataattactgtagcataaaacatgcattaaaaatgacagttgaatgaactccctttataaatgtttaaatgacccatcggatagccaaacgtacctgatagccaagcgtacatgaaggtttgattgtcttcccaggaatatggaaccaaacattggttttaaactatttttgaaatgtataagtcattatatcaatatattcaatttggatgattttatcttttccatgatgagtcatggaatgcagagcctttaataacaaaagctttaagggctcaggaaggacaagatagccttcctggtcttccatgagtctatgcttaatattggacttatgtcctgttgaataccagttgtttctccaatttaaattcatagcactgataactaatggttatcacaggtaatgagacttagactatggaattcaaattgtatatctaatcaatttcactatcggctggtttaacatgaaaatcttggcaaagtattttcttggtatttaattaattttttgttttacttgggttagcagttctatacaaggaagtttggttatttctgtgatatacaataacttaacataataactataattatggttgacagtatatactcagacatattagaattttataagtcctatacatttttttttgtttgtttttgagatggagtcttgctctgtcacccaggctggagtgcagaggcacgatcttgcctcactgcaacctccgcctcctgggttcaagtgattcttccacctcagcctcccaagtagctgggcttacaggcacccgccaccatgcctatctaactttttgtacctttagtagggacggggtttcaccatgttagccgggctggtctcaaactcctagcctcaggtgatctgccttcctcggtctcccaaagtgttgggattacaggcatgagccactgtgcctggccccatacaattttagaacatacattaatatcattcactaaaatataacctgaagattaaacattatttttattttgacaatgcttcccatgtaacttaacatgttaaataattctgtttacctctcttttggatgcttcaggggccctctgtagcgttccaaagttagaggtcagaaaagaccattttaaagctgaaatttaattttgggaagcctattaaatataaagatatatatataaagttttaaaacacttgatattatgaactagaattccaggtcactgtaagtcactcacttagccaaaatgatgactcaaaaaattttttaaaggcaaaaacctttactcattgatagagggaagactcagctttccaaacaatctgtcttttgtctttcctttcttttttttttttttgatagtgtatttaaaaggcaaacaaaacaaaaatctttcattaccttttaatattacatgaaaatcttgttcaagagagaaagccaaatttcacccttgcattagtggactattaatgtcaaccccaatttttaataaaacctcacagacaaatctatctaatcttaatcagtttgaccataaggtgagattttcataaaccttttataaccctttaccaatttttattaaagagcagattagtgctttaagaaaaccctattatgcttttatttcaatgttcaatttacagaaaaactgaacaatacacttttaaatttagtcaatattttcacacacagaatttcttttacaaatttttacaaaccttccacaacttgttcaaacctttagctttattctatttaatttaaaacaatcctttaacccattaaactaggtaaaaatttacattcccatgcattcttataatctcttaccaaaaacatgtttcattctcctcacacaccttgcgtgtaaacctagtttttcagtagtctcaatcacatgttataatggtaattcttagcaactttcacttttggtgcataaattttcttttatgaatcctttcacgacttacacagaccatctacaacatgcttggtctttctgacttgtcctaaacatccctctttttaaacaaccagtcattttactttaggacaagaatttactctacaagatcctttcttatataaaatctcttttctttataaccttcttttcatagctaggtggcatggctaattccacatatccccaggacttatttagaatgtaatgtctccaaaataaattcaacaattttcaaaggtcaaagcagtttatggccttaaacatattaagcaaacctaatatctgacctgcataatttagactaaatgtctttattttatcaataatctttaaagctgtttatatttcccaaagatgacttaagttacatgaactaaaaagcattacagtttttctttcaaaatatttaagcacttatttttgtttaaaccaatgaattagagttcttttatacaaacattacacacacaacacatatataactacacagacaaaccaaagaagattactacagtagttgtaagattttccattcaccagtttttaagtttcttaattagattactggctttggggtggagtcctcgcaagaacagggccaagaaaggatctctggtgcctcctgtttttcccaaggagtcccaggctgtgagagcttgaatatccacttttaattaagctgacttttaaccatagcactctttaataaagtccttttaaaatttcttattacccgactttagccaggccaaagagctgatatttctggcttttaaactttacccaaggtaacctcacaggtgctctgagaaaggaaaattcaagacagttggtggaggggaagagaatcaaaaaatggcaaaggtcacccaaatatcaatcagaaaggctcatcccctaagctagggattgaactctgaacccaggccaccattgtgaaaagagaaagcatagccacgtggctacaaggtcaagcgcctaagcacataactgaccagtttgctgggtcgtcttgaacaacaggcttatgaggttttgggcacacattttatcctaaggtacccctctttatgacagaacaatacagaaagacacacaaagcacatcagattcactacagcttaagagaagcctcagaattttttttgtatcaatcaaaactttacacgggagataagagtaatttttgccattcatttaaccattttgcacaaagaaaaagaggaaaaaagccagaaatatgactggtaagaaattcttacccttttactagcatgccaggcttctgggctttctttccctttccctgagcagccctagcgtcccagcttgccacaccatcgccctgggggccaagctgcatcataaaggaaaattaacttttttcgttttggccagaacaaaacacatatgataaaacatagacattagccactctgcttagcacccaatatcaaactggtaaggcttaaatttgccttcagatggcccctgtcatctttaatccaacctccaactaggagtttcaacacatggtctctgggcaagatggttgccctgagtaacagaaaagataggaaaggaaaggtagagaaagaaaagtattgcctgtggcaaggtggggaaggtgaagagctcagggaggccagagcaagacccactcattgcaatgacactgaaaaattcaggcggccacttgtcagtagtgaaggcatcttttccagcaatcccatcagctctcaagtttccccttttggggaggaaaaagcttcccatgtcccatggtcctgtacatgcctaatactgtcacctatagccgtcagcaaaaagtacaagacagattaatcaaaagagaatagcagttaacatcccatagcgccaaacctgttcttaactgaaagagactttactgagaaccctcatttttaaacacacttcattgctttgttgctcatttggaacattccactgtaagttacctttagtaagattttgtcatttctctaagactatgctgcctcccaggcctaatgtataagctggaaggaacttagttttccagaaattaaggatctcatttttacctaaaatattggcttgattctcagggtctcttgattaactgagccaatgatttttcctacctaagcatgcaagaaaaatgaaacaaaggggtagaacataaaaattcctgtgaattttcaaaagccaacttttataacccctgcaatattactgcttactatcagttcctttctgaaccagtcaggtgtaagagacctctaactggatccaagccaattaattcccagatcaaatccattcctggacccagctgagtttctgtcgtgacttccaaaccctgtttggatcagaaatttgctcaaagaaactcggagagctcaaaacacaaatccatggagctctgaaatccgagagagagcttacccacgatccccagctgctctgagagatcagtgaacacaagtgggtcctgcaggtaccttgtttgttcagttcactcaacgctcctggggtcgctagaagctctacctcagatcccatttctgacaccatctgataaaagaaaaactttagccgaattaaatttaaaggagtttaattgaacgatgaacaatttgcaagtcaggtagcccccagaatcacagcagattcacagagactccagcgcagccacctggtggaagatttataaacaaaaaaggggaaatgatgtacagaaattggaattaggtatagaacagctggattggttacagattgatgttttccttggttgaacacagtttgaacactcagtagtgtatgaatggttaaagtacggctgctgggattggccaagtctcagctattgttacaggcacatactcctagttaggttttcaatcttgtctacctattaagctaggttgcagttcttccacaagaactcaaatacagaagtacagagtccttctcaggacatatttagatcactttaacagcacatattggcagtcctcactgtgcagaactgtgtagtgtaagactgaaaaaccctgcaattaggcaatccacaattaatgggaaaaattatagttattcataacctttgaagttttttgttgaaacattaaaaatcattttactgccagttataacggtatggaaaaccacataggaaaggcatatgaaaaaaagtaaaaccaatattcatttagtatactatacattttttttaagagatgaggtctcactatgttgcccaggttggtttcaaactcctggcctcaagcaattctcctacctcagcctcctaagtagatgggagtacaagtgcatgccactgtgcctggctttagtgtatatactttaaaatatcaaaaatattgaggactaaagtgttttgcttctttgtaaaaaaaaaaatttcatttttctctgacggtggaggagaaattaatgtggatccaacctaggttgagccctctaacaagcaaccctaggacacttggagattcacattttcatgtctaaccttaacaaatattttcgtcattgcttttgcaaagtcatatctcatttttattatttccaacttattatatgaagtggacaccttttctatgccttggcaaactgtcataactctaagtttggatcagcttctaatattttaacttttgcattttcaacatcatgaaacatctctgacaattccttttctttttttttttttttttgagatggagtttcattctggtcgcccaggctggagtgcagtggcacgatctcggctcactgcaacctccgcctcccaggttcaagtgattctcctggctcaccctcccaagtagctgggattacaggcacccgccaccacgcccagctaatttttgcatttttggtagagacaggatttcaccatgttggccaggctggtctcaagctcctgacctcaggtgatccacccgcctcagcctcccaaagtgctgggattacaggcgtgagccactgcgcccagccgacaattccttttctaataaaactttaggtttgaagtagctatgatgtctcttgaaattctctacaggttttttgtttgtttttgttttgttttgttttgttttgttttttgagacgaagtcttgctcttgtgtcgcccaggctgaagcacagtggcgcaatcttggcacattgcaacctccacctccttgattcaagtgattctcctgcctcagcctcctgagtagctgggattacaggcacccgccaccatgcccaactaatttttgtacttttagtagagacagggtttcaccatgttggccaggctgctctcgaacttctgacctcaggtgatccacctgcctcggcctcccaaagtgctggaattacaggcatgagccaccgcacccagccagaattctctgcagtttttaagtgattccctacgggcttctagctggacactggacacagcctgattttatataaggtctttgtcgtaatattgacaatagggtttaccacgctaaatcagtggttttcaaaaactttagcatattttagcaatagttgtcaagcttttctcaagcaaaatcatactgaaaccaaaactattctggagtataggagtaggcatacacaacccagaatcctgtcccctaggcctctccctcagctcctgaggttgtccccaaacagctccaaaaacacagtaatttgcagatatctgcactccataggtcaaaagtctgtggttaataaagtactataaaaacacctacacaccatgatgcagatcaagtaggatgggatacatgggttctgcccagtgtactggcacctcagaatcatctcatccctctaattctgtttctctgttgcagaccactgattaggatccagtgttactctccacccatccttctaaacagatgcctcaaattgtttttgcctctcagcccccaccttgaacatggctttgattccacttttcaacatccaacttcagtagcaactccaagtcctgcctggacctaccagacaacagccctgtaatcaagagatatcatgcacgggccaagcacagtggctcacacctgtaatctgaggctgaggcaggtggattgcctgaggtcaggagttcgagaccagcctggccaacatggtgaaaccccgtttttactaaaacacaaaaaattatattttagtggcgtggcagcatgcatctgtaatcccagctacttgggaggctgagacaggagaatcacttgaacccgggaggtggaggttgcagtgagccaagatcgcgccattgcactccagcctgggcagcagagcaagactccgtctggaaaaaaaaaaaaaaaaaagagagagagttatcacacatggttccacacatatctaatttgtgttagtatttctctcttcatgtgccttttgctctgttagcctctcttaaacatttatctttgttctaaagtcttcatgtcctaaattacttccttgccctctttacaggatcaaaactagctgctggtaccagttttcagtaacaatgagatctgtcttttaagttggatgtcaataatattttggtcatgtcattacgagcatgattccctgtaacctaatctgagaaggcagacagcagagagaatgggcggtggaatggaacacagaaggaagcagattagaaaggaaagaaaacatcctcttgtaaagctttccataattctattttcatctttataaagatgcacgagaggagaaggaggagaaagaggaaagggggaaaacttaatggaaagattttataagagaaggaacaaatgcctttgtaaatactttctggaaatttgggaaggttactatgaatgtggctttgcatgcgtctgtgtatgtgtgtggctattccttcacttttctcggtgcccccaacaacaaaaacagtctgacctcacacctcccataaatataaaatctacttggaaaattccatcgaagtttaaaatatatatttgcgtattcttgattactaataattaccagctgatcatccaattcaaaaagttgttccaggtaagtttcagacaatcttcgaatgtttggtttcattgatggagtaatgcacatatccctttaataacatcataaaatacagtcaaaattaatttcattaattagttagttccgtaattaaatcagtgattcttgtaggtggaatgaaagggaggagaaggaaaacacatttccccttaggagaagcagatcagaatcacctggaggactttttcaaactactctcgcaagattttgctgtgtcccccaaaggaggatatgcctccctttcctctttcccaacttgaaataaaccggccctatgaacacgttactgataagaatacaccgtatttctcaggttgagatctagtgggcaaattattcaggtttgcgtctttgaaactgaaaagcctgtggagggattccttaacaatcttgagattggaagcattcattggcaagaccttattttgttactatgcaataaaagttttccttcaaaataaaatatttccctatcaaaaatcaaaacaatacttaccaaagaagattctgaagaccacttttgattataaccatgatcattccctctaaatacctcagcggatcctcaggacatgtaacaagtataccacataacagtgcctaggggaaaaaagggaaatggcatcaatgtttctgaattttcacgtttttactaagcagcacgtaactttttattgttcaatttgttttgggtttttttggtttttaattatttatttccataggtttttggggaacaggtggtgtttggttacatgagtaagttctttagcggtgatttgtgagattttggtgcacccatcacctgagcagtgtacactgaacccaatttgtagtctttcatccctcaaacccctcccactctttcccccaagtccccaaagtccattgtatcattctatgtctttgcatcctcatagtttagctcccatttatgagtgagaacgtataatgtttggttttccattcctgagttacttcacttagaataatggtctccagttccatccaggttgctgtgaatgccattaattagttccttttcatggctgagtcatattgcatcatatatatatgatgtgatatatatatctcacaatttctttattcaatcattgattgatggacacttgggctggttccatatttttgcaattgtgaattgtgctgttatagatgtgtgtgcaagtatctttttcatataataacttattttcctctgggtagatacccaatagtgggattgttatcccactactgatcaaatggtagttctacgtttagttctttaaggactctccacactgtttactagtttactttttttttgagcagagtcttgctcttgtcgcccaggttggagtgcaatggtgctatctcggctcactgcaacctccacctcctgggttcaagcgattcttctgtctcagcctcctgagtagttgggattaaggcatccaccaccacgcctagctaatttttctatttgtagtagagacagggtttcaccatgttggccaagctggtcttgaactcctgacctcaggtgatccgcctgcctcagcctctgaaagtgctgggattacaggcatgatccaccatgcccagcctagtttacattttcaccagcagtgtagaagtgttcccttttcactgcatccacgccaacatctattttttttttttattttttgattatggccattcttgcaggagtaaggtggtatcacattgtggttttgatttgcatttccctgatcattagtgatgttgagcattttttcatgtttgttggccatctgtatatcttcttttgaggactgtgtatccatgtccttagcccactttttgatgggattgcttttttcttgctaatttgtttgagttctttatagattctggatattagtcctttgttggatgtatagattttcgcctactctgtgggttgtctgtttactctagcagcagcaaactttttcttatacagttaaaaagtcaaataatgtgacagttttaaagtaaatgtgtttttacatacccctctgtatttattcagtgttaatattctgctaaagtaaaacaaaaatgcagtttatcttgcctctttctaaaaatccatcataaacaatacaataaagtcactgtaccgtgagggtttgcattacttgaggagtaagttctttatagccaatctgaagacataactatgatgctttacatcagggttttctagccttttaaagtatgagaaactcattggggttggggggggttgttttgttctgttgttttgttttgttttgtttttgttttgccaaaaagttccttagacccaaccataaaagagattgagaaaatccaccattaaaatgtgtgaatttaagaactcttaaaaacacatttgtattttatcattcacaacatctaccgagtatatacatttgaaaaattgtagcttagtacacataggtgggaaacaatggacttgctggatctaagatactgtttaaagcacatatgtggaactcgtaaagttgctgctgtctcattttccttatgaggtccccccaaaagaagaaacttcttgttaaaagtgtctgcaagatatacagaattactgatgttttctccatttgagacagatgaaaaggtctgcagcacacttcccacagaaaccacctggaattctccatcggcatttctctttccctttgtggttcactgttttctggtggggtctagtgtgcatgttgggggtggtcgggatgcttcagacccactcctgctggcttcttctcttgatcctctatttccagaataaaataattccatcacttgagttacacagagcagttctccctacctccataggccaagtgtcagcagatctaggcctggggtcttttcttagactctcagcaattctcatactgttcctccaaaactaaaaagggtaatttctcctaattggaccctgcataataacaatctccccctttgcaatggctccatgctcctcttcttagtgtacagccttcaagcaggaagctcagtcctttagagaatggcagaaaggtaagatttagatccctctccctctccagctctgccttcagaccaagcccatagtaactgcttacaagtgctcagccacctgcagactgacttccttttcccccaaaccaagagactatagttgcacaggagattagtggtctcaccacagttgcaacctgaatttggacagtcatctattacctaaagagccagcaagagtgggtcctacagggacctaacaaaaagggctgaagccatctattatctggaggccaatcagacttcccacagctccctcaatatccttggtgaaaagcccatctgctctctagcacttctgtgcctgggtctccagagtactgagtttttgtattcctcactctacatccttttctccatcttattctggcaccctgaggacatctatatcagaatcacctggagaatgaatttgtctctgagaatagggcctagaaacctgcattttactaagctccccaggtgattcctatgcatactgatgtctgagaatgagtgcctaaatgaagttcagctttatggtacatttttaagaaagttgagatctggttaatgtatgtgagaaattgattatatatatatttccaagctccacttataataaactacttttcctgaaaagctatcctgcagaagtcaggttgagaggataagtctctgaaatgctaataaaggcatatggaactagcagagttgaaatgcacacttttcacataggaaatctcactgttggccaggtgtggtggttcatgcctataatcccaccactttatgagaccaaggtgggaggtttgcttgaagacaggagttcaggactacccggggcaatacagtgagaccccatctctaaaaaatacaaaaattgttttaaaaattagctgagcatggtggcgtgtgcctgtagccctagctacttgctaggtgggaggtgggaggtgggaggattgcttaagcccaggagttcaaggctgcagtgagttattatcacaacactctactgcagcctgggtggcagagaaagaccttgtctcaaaaaataataataaagaaagaaatctcactgtttgtctttttcccttggacaaaatagcacagcatgatattttttgtattaatgagtgaacagcgcatagctacatgccaataagacagcagttaatgaatcaatagctttttccctgcccaatgaaaataaaaatcacaaaaccattaacttagtctttattgtaagcagaagcaaaataaacattcccataagattaacgtttgactctcaaaaacattaatcagggccttattattaataatattctcagtaaaaacttacacaatcaaggacaaaaaagtccatgagttaattattggattagctctctcaagcttgtaaattcacaaagcaattacgtaatcctcagtttcttttggctctacttccctacactcagttcccaatatttctcatctattctgaaggatgttctgggtcctgaggacaaacatgggtttaaccaggactgttgcttccactcctttctcctgctacctatctttcaaagagcaagataatgcaaagggtggagtccacttggtttaaatctgggatctgcaatcttctaccatgcaaccattgacaaattacgtctgtttccgtttccttaaaaaagggggataataaaggttcatacgctatagggctatcatgaaaattaaaaactgctttgaatagtgtctagcacaaaataggcattcaacagataatgatagcaagatattttatatatatatatatatatatatatatatatatatatatatatacttttttttttttttgagacaaggtcttgctctgtaacccaggctggagtgcagtagcacaatcaacccagtgtaacctcaagctcttgagctcaggcaatcctcccacctcagcctcccaaggagctaggactacaggcatgagcccccaaactcacttaattttgttgttgaaatggagtctcactctgttgcccaggctagtcctgaactcctggccttaagtgatcgtccttcctctcagcctcccaaagtgctgggattacaggcatgagccactgtgcctggtccatcactatttttaaccattccactgttaattatcaccttaattagaggaaaacacttggacatagagaaaataaattgaaaatattcccttgtaccactcaaagtccagtgtgatgactgagagagaaagacagagactgactctgacttaaaccacacctaatagaagatgttaggacaaaagcatttaggggaaaatggctaggagagaactgaatagaccaatagttcaaatataaatagcaagatagtaactattataacccttggtggacacacaaaaacaaatgtaagacacttaagagaacaagtcttgcttagctttttagatactcagataaacatagtgaaatacgctgagggctgaaatagtaatattataatataaaaaataattactccaaaagtgcagagataaaagtgattatcaaatacttggggaaccctcagcaggtgaagaaacagaaaaacattgttcaaagtcccttccatttccctatcccctaccccaacctctgaaacatatctaaagcagtatctcacaaatgattgccatccccctgtgggacggagatggaggtagcacgctgttgttttgggagatatcttaatttgtatttatggaagttagtaagtcacaattttgaaaataaaggggcttttatgtctttttaacattgaaatagatggtgtcaaaattttattttagaaactctataaatgaatattccggaagattactgaaagaggccaactagcttcaacattcagatgagaccccaggaagaggaagatgcccctcaggaccagacttgaagggttttttttttttgtttttttcttttttgttttttgttagacttgaaggtttttaaagcagactggacaggacaggtgaggagcagcaggctctatgaggtaagagtgagacaaaggactctgatacctgccggactgggcctgtcccagaggggaagcagtcccagccgtctcatcccctctaagaaaattgttattggaaaattaataaatcatgtgcttttctttgtttagtgtcctgtggatttacctcaggaactacacgtgtaaactgcctggctgggctgagggaattcagcaaaggtaactgtcctctggagaagccacagccttcctgcccaaggtccagcaaaatgagttagtgtatccagctcctcctctcctaaatgggcagggcagtcccttgctcaagaatcagcaatttctgattcttgcatctctgacaaatacgtgcagcaattagtctcttaaaaaaaaatacctggcccagcacggtggctcacgcctgtaatcccaacacctgggaggccaagacaggcagatcacgaagtcaggagattgagactgtcctggctaacacggtgaaaccccgtctctactaaaaatacaaaaaattagccaagcatggtggcaggcgccggtagtcccagctactcaggaggctgaggcaggagaatggcaggaattcaggaggcggagcttgcagtgagctgagatcgcgccactgcactccagcctgggcaacagagcaagactgcgtctcaaaaaaaaaaaaaaaaaaaacctgattggcaacttaatcttgaaagaaacataaaacataaaaacttctcagaaaaatcataattaccaaaaaaaaaaaaaaaaaaacaaacctttgctttaaaaccataatttgtagattaagtactccctctgctgagcagatctggttttgcaaactcttttcatcttccctaaatgctaaactgaaattggagctcaccatttgaagagtactttcttcctctcagatacaatcactaggtgtatctgcttaatgtttttgtagaccataatatctagctcatctttggtccctgtggggcagtccttgtttgtctgtaaacaatgtactgacttctacctagtagaaaattgagggagaaactagggtttctatgttatttctggatgacccactgtctgaaggtctaccaataaggctttattatatgagttcctatcttaataatctctttcaaaacacaaatgcctttgggaaggagtatatccaaaaatagagggcacattaagctaattcccacagtggtggaaagagtatctcagagttctgagagacagaaatgaagaatacaaggagagtgagggatcgcaaggcaatacttagttttcctacaatttctacctatcttcaggtgacttaaaaaaaaaaaaacctctgaatttctaaaatatatttttcctgaatcttaatgatgaaatgtaaatatcttcatctctatttctccaagatagatttctatgaaaatatagaatcaaaaggtatatattacagatcttcatacatatctcaaaactgttttcccaaaaggtattatcaatgtataatctcatcccaaatggataaatgctcagagagctcaggagacaagctcaggctagggacagcctcagagttacagctccaagtggttgaagccattgaggtgttttcaactagcacgtggtagagacccagcaaatatttgctgatagaatgtcctagtgtatccccctcagctgaccactcttgctgttccccaggagaaaagactggctggtgtcaagagcctcatctgttcaaaaaattaagttacttgtttaacttgaattgaacatagaatccagtagtctttaagttggacatgtgaatctccaagagcccacaaagacttttgaaggattacatgggcaagaatagtataacggagtccactttcagatcttcacctttcctatgcaggttggccttctatatccatgggtcctgcatccatagattcaatcaaccacagatcaaaaatatttgaaaaaaagttttatctgcactaaacacatacagaatgtttcctcttgtcattattccctaaatgaaacagtataccatctacttacatagcatttacattgtattagatataagtaatctaaagatgatttaaagtatagaagaggatgtgtataggttatatacaaatgctatgccactttttatcagccaacatcagtctccaaggaaggtcttggaaccaatcccccatggatactgagggattactgtattctttacttaaactgatctgcctgaggacacagtttgctattttctttttctacttttctctttcacaatggctcttcctcccactctagaaaataaagccctctatcacatccatctggaatcttactataaagaaaactgaagcagagagatttggaaattttctcagtcacccagttaacaattggtgaagcctagaatcaaacttaggctttttttttttttttttttttctgtagagacagtctctcactatgttgcccaggctagtttcaaactcctggcctcaaggaatcctcctgcctcacactgccaaagtgctggaattacagtcatgagccatcatgtggggcctaggaaggtcttacaaataagaaataatcccctcatcttgcttcagatgctttaggtttcaagtaacaaactcaacttaatacgtactctattagctcctacaagaaattcaaaggtagatgaagcttcagtgtgggtttaacccagtggcttactgatgtcactagggcctggtttctttccatttccccaactggccttttgtggaatccacttcatgctaaaattctctctccttgtggccacacaggtaattgccaatgttcccaggactaagtgcttccccatcaacatccagagagggtatatccaaccagcatcctgatctaaatcagcttggattacatattgccctcccccatgaccctataccttctgcctccctgtcgttacaaacattatggccagggaaactgaatgcaccggttgttgcaagccagttggggtccaaccccagagatggggatagacagttttcttgaagcaaatgggctaggtgagggaagagacagcgtatagaataagaatgtaggaaatattaggaagagggaagtagatgctacgtaggcaacttgtaaatgcccagtagacatctgctcctggagaacatgggaaaggaagaagaaaagggggtaattacagtaattgagatccacttactgagtgatgctgttgtgatctatatctttttagagactgctttgagatccaacttgatctgactccccttatatgaacaagccaagtatggcagattatattttccacaatggccataacagtatctcccatcctccatgttctttttgcaatgtgcctttgttatacctcccatcatgaaatgggttccatgttccctccccttgaatctaagtgaaaataatgttgacttccaaatctagatcataaataatggtataacttctacctggttctctctggggaggtttggtcttagaaatcagctaccatactgtgaggaagtctaagcagcccatgggcaggtccagatgaagaggaaccaagcctactggttcacagacctggctgaactcccagccaacagccagcaccaacttgctaggcatgcaaaagaagatatcatcttaaaagtggatcttccaccccctgcaaaaccttgccaaaatttcaaatttttaagcaaactaagtgattcctgttgttgtaagccaccaagtgctttaactggttgcatgtcacatggcaatagataattgacacaccaaacaaacagaaaatgactacacagccaaatcaaatctgtcattccatccatccctagcaacatacattctgaaaaaaaaagcctagccataactatctttcattttagatttttaaatttcaaacatttagaaacagtagtatagggaacacttatgtacctatcacccagtttcaacaataattattctgtgatttttgtatcatctatatatctacccatttctacctattctcaattataatttaaggtaaaatttatattatttcaaatgcataaatcttattagtataattttgataatgaaaatacccacaccccgggtgtggtttctttccaactctccggaaagttctcatgtccctctccagttaatcctcctgtatcactcagagtccagtcaagagacagaaatcacacccgtgttttgaataaagaacaatttattctatctcataaagagattctaataaagaatgcaattcaaagaattactaactagtaaaaagagagtaactactaagagcaaaagagaacactaaaggacaccctgtggctcagacagagtacccaaagatgaaataaccttggaaggagggcagccacctccccaaggctgagattcagagaatgtggagtgtggctgaggtatagtggggaagtccattaggttgccctgagacagagatagttctcagccatgatggtccaaggcttggtgaacaggaccccaccagctcacactagtgagcagacgccccctgctggggtgccaatgggctgaggctggtgagcaaaacttgctgaagagtgggcaccactgggtgcaccacacacatgctcctggaagctgtgtcatgtgaacaagaagtgaggaagcacacaggaaccaggaactgaagtccctctccctccagggtccctccagcactgacaaggcttaacaacatgctagcccaaagcaatgccaaggtctagatcatgacaccagtccagcttctaggtgtcaagggctacttttctcctcctcaatatttctgcagtattataatcagctgtctagttttatggggaaaaaaattttagactttaactaaaattgcattgaatttatacattttctgggaagacattacatgttgttattttcccattcataaacacagcagagtacttcatttctttaggtcaccttaaacatctttcaataaaattttacaaattcctccaaacaggtctttcacatcttgtcctaagaaaccttatattttttgtggctattatgaatgtaatttctttttttttttttgagacagagtcttactctgttgcccaggctggaatgtagcggtgcgatctcggctcactgcaagctctgcctcccgggttcacaccattctcctgcctcagcctcctgagcagctgggactacaggcgcccgccatcacgcccagctaattttttttgtatttttagtagagacgaggttttaccttgttagccaggatggtgtcaagctcctgacctcatgatccacccgcctcagcctcccaaagcgctgggattacaggcgtgagccactgcgcccagcctatgaatgtaatttttaaaagctactgtttaaaactttggttctagtgaattgaaatgcaattgattttttaatattcagtggaagaattttgtgaggatttttttttttttttttgagatggagtttcgctctcattgcccaggctggagtgcaatggcgtgatcgcagctcaccgcaaccttcgcctcctgggttcaagagactcccctgcctcagccactcgagtagctgggattaaaggcatgcgccaccacgcccagctaattttgtatttttagtgatctttctccatgttggtcaggctggtcttgaactccaaacctcaggtgatctgcccgcctcggcctcccaagaatttttttttttttgtctactctttcactgtgggtgtaatggaattgtcagaaactgaaaatactaggaaatgtaggactatggatattgagagcccatttgacaactgaggattgaatttaaagtgacacaattcagtttaattgtgtgttcttcctttaaataatgttcagttgctcaggggtaagcacggactgctggatatttgagttttaccagggatgggtgtttgtcacatcaataggacagagggagaaacaggtaaaggagataatcgtatttgaaagtgatcataatgatggtgtggtggcattttaaaagcatgtctgcaaatgatatttcttacataaagaggtggggtttaattcctctcctcttgaatatggattagtcttaataatccacttgtaatgaagagaatacagtgaaagtgatgttgagtaacttctggggctaggttataaaaggagattttacttggctctgtctcttggacacctgttttgggacccagcctccacgctgtgaggaagctcaagctacatggagatgttacacatagatgttctacctgtcagtctcaggagaggtcctcatcgacagccagcatcaactgccaggcatgtaggtaaggaagccttcaagatgattttaacctcagccactctgacatgtaagtgcatgagggatctcaagcaataatattctgtcaactcccataactgtgagaggcaataataaaatgaatactgttattttaaatcactaaatgttgtaaagacatttaggtaatagacatccacaataatgatgaaccaaggaatctaagatgggtaaagagagaaataaggacataagagtaatatttgacagtgcaaagataattgaatgaaatggtggtttgagtcagttgaagaagtgctagtgtagaagctccaatgtgagtgagctaagaaattaagagataagtggatgaagaaatggagatttcagagatggtacagcaatttaggataaaatggttaagagtatgaccatagaaggacatgactgaggaacggtgaaagcaaagataactggaagaaaggtcaaggatgtgaacggaacatccctgtgaatactgcgggcacaagaacaatgacaggagtagagaaaaaggaagatggtgagccagatgctaatgctaccaacaaaacatagagattggtacataatgaagacagtgagtgctaaatctgatgttatgaactacaaagaagctgagactttagaaaaaggagggaagatacatagtttggaagtggaaatggggagccaaggaagacacctaacctatctctagatctgaggtaaactgaggagtgaaacaagacagtctccctaggatttcatatctgagtaggatgtggaaagtcaccatggtccaatgaccctgctacaacaactagaaaaaaacagacacattacaaaaatcacatttaaaaaagatattggcgagccatggaattccaggggaaggaaatttttctgaagtgagctgacaatgcacagctgctttttttccctgggaacgtgtgccagctctgggtaggaaagaggacagggctgggcccaggcagagaaagtctacaaatgggaagagaaaccaataggcttatggtggtggcacgggggtaacatgacaggttagaaacttgaggtgccccaagtgtggccactgtctcccataaggcagtgagttctgggagtgttcacacaggaggctgaggagctagaacatcaactcctacaaggcagagtgagtctttcataatctcagggaaggaagaggaagcctgcctcaaacatacagccagcataaccttcaatgtacttgccagattttaaagttgagggcccacggccaccacgccatctgggaagtaaggagcacctctgcccagccgccccaccatctgggaagtgaggagcgcctctgcccggccgccccaccgtctgggaagtgaggagcacctctgcccggccgccccaccacctgggaagtgaggagcacctctgcctggctgtcgccccctctgggaagtgaggaggccctctgccctgccgccccactgtctgggaagtaaggcgcacctctccctggctgccccacagtctgggaagagaggagcgcctctgcccagccgctgcaccttctgggaagtgaggagcgcctctacctggttgccgccccatctggaaagtgaggagcgcctttgcccggccgttgtgcaaccctcgaagtgtgaagtggcagccttgtgtgtgatttttatgccctccccaagtttgcatttttgatattaaagtttacttttaaaagttttaaattggggaatatatatacatatataaaagttgagggcctagaagggaaactaaagagctaagcttaaatacctccgaagagcagaaccaaatctctcacaatctttcagtctgaggagacagagactggctagcttctcaatcaaaagcccagaagagctatgcctgaggaatagggatgaaccagatgtaaaccgaacccaaataaatccacagtccaagctcaacacagatcagtcccttcctggactgaggtcatgagctctgtaccctatacagaggaaaggacgaacctttgctggcgaaagagtatatcatctggaacttctattgttcttttctcacacaatgtccaataaaaataagaaattactaggtatgggctgggcgcggtggcccacgcctgtaatcccagcactttgggaggccgaggcaggtggatcatgaggtcaggagatcgagaccatcctggctaacacggtgaaaccccgtctctactaaaaatacaaaaaaattagccgggcatggtggcaggcgcctgtagtcccagctactcgggaggctgaggcaggagaatggcgtgaagccaggaggcggagcttgcagtgagccgagatcccgccactgcactccagcctgggcgacagtgcaagactctgtctcaaaaaaaaaaaaaaaaaagaaattactaggtatgtatgaaggcaggaaaatgtcttgaattatcaacagaagaaaataagcaatagaagcagacccacaaatgatctggatattcaagttaacaaacaatgatttaattttatgtatttattttatttatttatttttttagagacacagtctcactccatcacccaggctggagtgtaatggtgtgatctcagctcactgcaacctctgcctcctgggttcaagcgattctcatgcctcagcctcccaaatagctggaattacaggcgtgcaccacacctggcaaatttttgtatttttagtagagacagggtttcagctggtctcgaactcctggcctcaagtgatccacccacctcggcctcccaaagtgctagaattacaggcataagcaacaaacaataattttaaaataacaaccatcaacatgtgtgttgatccattttgcacggctataaagaaatacctgaggccaggtaatttataaagaaaagagttgtatgcggctcagggttctgcagggtgtacaagaagcatggtgccagcatctgctcggcttctggcgaaggcctcaggaagcttttactcactgcagaaggcaaagggagccagcatgtaacatgggaagagaaggagtaagagaaacagctagagggaggctcttctaaacaaccagctcttgggtgaactaatagagggagaactcactaattatcacaggggagggcacaaagccattcttgagggatctgcccacatgactcaaatacctcccactgggccccacctccaacactggggatcaaattttaacagatttggagagaacaaataaagaaaacagaaaaaggcaaactgaatgaaaagatgcataattctaataatcagaatttatttaaacatcaaattgtcattctagaactgaaaaacatgtctaaaattaagatttcatttgatgtatttaagagtagactggacacagcataaaacaaaattagtaaacttgaaaaccatcaatgaaaaagatccaaacttgagctcaaaaagaagaaaatggggaaaaagcagaagagatcaaaagaggcatgtagaacaaggtaaagaaaaagaaaaaaaaagctaacatatgtacgattggagttccaaaaggaaaagagagaactgaatagaagtactatttgaaaagaaccaagaattttctaaaacggatgaaaaatatctatcaacagattcagtaagcccaggggaccaagcaggattgtttaaaatgttttttaattttttatttttttagagatagggtcttgctccatcacccaggctggagttcagtggtgcaatcatagttcactgcagcctcaaattcctgggctcaagtgatcctctcctctcagcctcatgagtagcagggactacaggtgtgagccactaagacaagttagcttttttttttttttttttttaatttttgtacacacagggtctcactatgttaccgaggctggtcttgaactcctggcaagcaatccacctgccttgggctctcacagtgctgggattacaggcatgaaccaccaagccaggcctgatttttaaaaaaatcagtctctattcaagagatttgcaggaaaatgatattgtaggtagaaaatcaggttttatttaggacaggtagatgaaattcagaagaggttaaatatacagggaaaactttaatgaaaggttatttatgtattccaaggcttgcagaagatgggttttagaaaagtataaaacctgccagacatggtgggtcatgctgtggtgggtcatgcctgtaatctcagcactttgggaggctgaggcgggtggatcacctgaggttaggagttcgagaccggcctgaccaacatggtgaaaccctgtctcgactaaaaatacaaaaattagctgagcatggtggcaggtgcctgtagtcccagctatttgggaggctgaggcaggagaatcgcttgaacccaggaggcggatgttgcagtgagctgagatggcaccactgcactctagactgggcgacagagctagactctgtctcaaaaaaaaaaaaagtataaaacccatctgggaaattgagtcagataaataaatgtacagacaggatatgaggcagaatggaattcatcttgatattctcttagaagaaatgggtaatgagtttaaggtgggtgtgtggggcccagaggattgctcctttgcacttcctgctagtgtgctagcagaggtgagtgaaggactcctcaggagaacatgatcttagacaatggagaatgcatataagggcctcctctatgggtgcagaacaatgcagtaagctggtaaggaaggaatgctttcacccagagggggaactggggactgcctcattgcagctttgtgatgttatagtaactggcggcctagatgagaagaggccatcccttccttgatgtaccctgactctcaactcaagtccatttctgccacctgctccaccgccatatcacagactgagccatcactcagaatggctgcaccctgaattgtaaatataaacgttccactttctgacccccacctcctgtgtttccagctccctcacttaattactccctctacttctcttcactcacctcttagaggagtcttcactttctgtccatgtatcagtatgatatccttttctcatttcccactgagtccttagagtccttggcccatcacttcagatactcaggagcttagctccctaacctactgcctttccattctattaatatatgcctggcaaattcctatcccagacgaagtcaacttggttatctctgtacctacatctgatttactgactgctacttgagaaaatcacacaaccgggaagatgggtaccattctccctacatattttcaagcacaattgtatagaggtacaacacaaaactcactgtaataaattaaaacaatacagctatggacagagtaaaaagttagaattctccatcttttcccccaaaaccattccacaagacatctgttattaacagtttggcataggttctatgcatgcactattgtcttaaagctagatatatacacatatatgtacataaacacatatacaacatatatgaaatcaaatggacagctagagcagaatggacagttgctaagcaacttgcactttttcttttttacttaataatatgtgttgggagccagccatgtggtgtatgcctgtagtcctagctacttgggaggatgaggtgggaggatcaattgagcccaggagtttgaggctgcagtgagctaggatggagccactacaccctagcctgggtggcagaccaacaccccgtgtctcaataataatgatgataataataatatgtcttggaggacatttcttcttagtaggtacagatatactttattctacataatgcctcattcgcttagtcactctaggtcatttactatttttactatgaaacaaagttataatgaatatccttgtacatcctcctgaacacatgtgcaagtatttctctaaagtagatccctagaagtagaaatgcttggttaaagggtacatgtatttaacatcttaataaatatttctcaattaccatccaaaaaagagacgggtggggggtctctaccaaattgccctcccaaccgcctaggagcgttactaccctcaggtaggacctcctctttctttccctagacatctctctccctcattctccacataacgtatctttgctcgaacctcctactgcaccaacatccccatccccactcaaacacgcacattcttggtaaatatctcaccaactatttgtagagaaaaaaagaggtcaacaaaggcaaatgttctcagcttcctacccccaaacctacaaaacctaatgtctatccccttcctgtcttccttccctactcttataacggcagtaggagggcagtccttcctgttgtctaaaggcaatcctggttgagagggtccttaccttcacaaagggctgactacactgaccaaaggtctcagcttccactcttccctccgctaacctccatctattttctgccctcacggctccatggaaacctcaggctcaccttgggcagaatccagctccttatcttaggtgactagtgcctactccctacttctgacaacattcttcataatgccagtctgctgattttcctcctcaggctctctggcacttctttctcactcctccactcctcaggtacttcttgtccaaaccttaaaatctgagtttggggtttccgatctgggccttgtgctcattccccctgggagatgtcacccattccccacgtgcagccaccatcaccctctgttttctctctaatcagcgtcttcagccctgatcgcctacaagtccgaatttgacttcactttctcgcattctgccccgccttccctccactcctccccaatcccgaaacctagtccctcctccgggaagtctttcctgactcctcccccttctaactccccaccgacggtctgtgtccgctgccacgcgtgtccagtacctcgcagacctgaggaatgtagttctccttgaagtagttcttcagcctcgggttggcattgcgtagcgaggccatggcccaaggcctgacggagaagctgcgatagtaccctccccgcgctgggactaggggccgggcgcgtgcgggcgttgtcccggcaaccagggggcggggctgggcgtggcaccgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgggaccccggggtttccggcaggtgggcggggactgggcaggggggctccccaggccggggtggtggcttgcgtgtgctcggggtaaaatgaggagccgagctagagggagaggcagtacttgtgtgagtgcagggtgctgcgccgcccccgccgcccctttgctgactatactggtatgaaaacttgccctggctttcctgcctgagctccgcgtcacagcggaggattagatttcttaaaaacctgttgatggcctctcattttaaagcttgctccgggcctttgtgtaactaaagggattctcccgattgtggaagggctgttgaggggcccagagccataggtcaatctctgcttgcaggtgccctggaagaagggacgtcagagggtcagttgtgcgggcgctcggcccggcctcagacgggaggtacctgggagtcacagtggtccaagacctcgcagcctggtgtgtgttttggaaatgggaacagttgtctgcgcgagacacaccctcccagcggacaaatgcatgattcggtttctgtccaaaagttgatcggtacattaaaaccctccaaaggcatgtttcacatcatggaagctgttagggaaataatttaaaatatcatatctgccatccaagaaactcctgtccacaattgtagaagagagctaaacagcttcattgttgaataagcacaaactaaattgcctcacacatcacgggcaatttgctaatgggatagcaggaagaattctaattcctttaaatgtagctggacagatagaaccgatttcatattacatacgtgttctcaagataaaaaataatttgtccttaggtaagaggacttgacagtaccatttgctacatgtagtttatcctgaatttactggtaattggggtggttgttatctaattgcctttatccagaggaaaaataaaaatatctttatgatgtggaaccaggtgcccaggctaaaaactcacagagttggggagattggggatctatcttcctggaagagtaggtttcaaagagtacgctttcgaacagtaggctccaaagcttttaagaaagtctttcttgggctgtaaaactggccaaatgcttatttcacttttaaaaagatttacaggctgggtgtggtggctcacacctgtaatcccagcactctgggaggccaaggcaggcggatcatgtggtcaggagttcaagaccagcttgaccaacatggggaagccccatctctactaaaaatacaaaaattagccgggcttggcggtgggtgcctgtaatcccagctactcaggaggctgaggcaggagaatcacttgaacccaggaggcagaggttgcagtgtgccaagattgcaccattgcactccagcttgtgcgacagagcaagattctgtctcaaaaaacaaaaaacaaacaaaaagatttacatttgtatcaaagaagcagaaaaaggagttttgttttgttttcagacagggactccctctgtcacccaggctcggtgcagtggcgcaatcacagctgcagcggcgcaatcacagctgcagcctccacttccctgggctcctcccacctcaccccactaagtaactaggactacaggtgcacaccgacacctggctaatttttccaattttttaggagatgagttttcaccatgttgcccaggctgatttgaacttggcttaagcagtgctcctgcctcagcatcccgaagtgctggaattacaggattgagcctcctcacctggccaataaaggatttttaattacaagtttgcacgagggaatgctttaagaaaaagggagtggaaggggaaggtctctctcacttttgccactaggtataattcagctttttttttttaaagatttgtatgtacccttactgtattagtccattttctgttgcttataatagaatatctgaaactgggtaatttattaggaaagaaatttatttcttagagttatggaagctgagaagtccaagattgaggggccgtagctggtaagggctttcttgttgtggcatagggcatcccaaggccagaggggcaagtgtgttaacatgctgactcaggtctcttgttcttataaagccaccagtcctgctcattaatccatgaatggattaattcattcatgaggacagacccctcatgatccagtcacctcttaaaggccttacctctcaatactgccacattgggaattaagtttcgacatgagtttcgcaggagacattcaaatcatagcatttacaaagcctaatttgttgtctttgcccatgtcagagatatttttgtataagtacattgggaaggtgtcctggactcagatatcttctcagttatactgactcaatctgatgaatgtggacagtcttttaaacttaacagttcccataatcatcattatcttaggtaaggcagcttaaaaaataatttgctcacagtcccttcttcctgaagctactcctttatcattgaagaagacttgagaaatgctcatttcatcatcaatatggtttggctttgtgtccccacccaaatctcatctttttctttttttttgagacggagtcgcactctgtctcccaggctggagtgcagtggcatgatctcagctcactgcaaccgccacctcatgggttcaagcgattctcttgcctcggcctccggagtagctgagatgacaggtacacaccatgtgcctggcgaattttttttgtatttttagtagagacagggtttcaccatgttggccaggtgatgtgcctgccttagcctcccaaagtgctggaattacaggcatcagccactgtgcccggcccaaatgttatcttgaattgtaatcccataatccctacatcgtgggagggacccggtggaaggtaattgaatcacgggggcagttcccctcccctccatgctcttctcgtgatagttctcaggagatctgatggttttattaggggcttccccctttgctctgcactccttctctttcctgctgcctatgaagaaggaagtgtttgcttccccttccaccatgattgtaagtttcctgaggcctccccagccatgtggaactgtgaatcaattaaacctctttcctttataaattacccagtctcgggcagttcttcatagcagcatgagaatggactaataaagtcatcatcacgcttagatttcagaagatgatcttttgttttttgtttgttttgtttttgtttttttttgagacggagtcttgctctgttgcccaggctggagtgcagtggcgatcttttctttgttttaaactcacacctctaatccctttgggaggctgaggtggaagaatcgcttgagcccagagttcaaaaccaggctgggcaacatagtgaaaccccatctctacaaaaaatagaaaaattagccaggcatggtagtgtgcacttgtagtcccagctactcaggaggctgttttgggagaaacccttgagcccaggaggtcaaggctgcagtaagctgtgattgtgccgctgctctccagcctggacaaaagagcaagactctgtcttaaaaaataaaaaataaaataatttttgtactaacgtggtttgagagcattgaaaaagacggaaacagtcccaattcatccaacaatctaacgtcataacctgacaaggatggtaagaaaaactataaatctgtctcaactatgaataaagatataaaaatcttaaaatattagcaagtcaaatctatcaggggattaaagtaataatataccaaggccaaatggacatggaaggaggagtcatactagaaaaaggaaaagccacatgatgacctcataataaaaaggcattaaaatatttctttccatagctgaagctcggggaaaaaaaaagaaaaaaaattttatcatttctgataaaaacttgcagcaagtaaggaataaatagaaggaaatgttcttaagttgatcaagtacatccatcaaaacccaaaagcaaatatcgtatttaatagacacactagttagtagcatccttatcaaactcaagaacaagagaagggtgtctgctatcacagctactattcaacgttcttctggagtcatagcttgataagaaaacaacatgcataaatattggaggcagaattataatcgtaggtggcataatgatttacttggaaaaatccaagagaattaactaactactagaagcaatgagtttaataaaatatcttgagtacaagtaaatatacccaaatcaataacttcttgtatacatgcagtaacaattcaaaattttaattgaaaatattttatttgacagaatgagaccctgtttcaaaaaatatatatcattcatgatagctataaaaactttaaaaattaggaattcactttaaaaactaggagttcctgtagtgagaagataattttactgaagggcctaagactacataaacaggcatattgtgttcccagttggaaagattctgaaccatgacagttatcttgaaatttgtcttgctacgttataatgtggtagtcacttttcattccctttgagaattctaatttctccttgatttactggaggagaccacaaaccaccgagcctaagattctttcacagtcttgttggcacagagctagatggaaagtagaacacatgtttgactcctcacctgtgtaatagcagtccaaaaactcaccagtggaagagctgagtatttgatgatcgccctcctgtaaaatttttagagttttaagttttacatttctttactaaaaagttatacatggtttttgttttgttttgttgttttgagatggagtgttgctctgtcgcccaggctggagtgctgtggtgcgatctcagctcactgcaacctctgcctcccaggttcaagtgatgcttctacctcggccacccgagtagctgggactacaggcatgtgccaccactgctggctaatttttgtacttttagtagagacggggtttcaccatcttggccaggctggtctcgaactcctgacctcagcttatctgcctgccttggcctcccaaagtggtgggattacaggtgtgagccaccgtgctgggccgataaatggtttttattagaaattcaaagagaatatatagaattaaagtataggctcattattttattttttatttattcatttattttttgagatggagtcttgctctgttgcccaggctggagtgcagtggtgggatctcggctcactgcaacctctgccgcccaggttcaagcaattcttctacctcagcctccggagtagctgagattacaggcatgtgccaccatgcctggctaatttttgtatttttagtagagacagggtttcagcatcttggccaagctggtcttgcactcctaacctcgtgatccgcccatctcagcctcccagagtgctgggattacaggtgtgagccaccgcattcagctaggctcattatattaatatactaggaggaataatggttgagaggaaagagtaatgtaggagtaaaaagatctggattctaaagccacttttgctattattaatcagctatgtgtcccattaatgaaaataatatactagtcactttaaatattctaggtacaaaagtgctttgaggtaggcactattaactcccacttagcagatgagtaaactgaggctgagagagcctaagtctcttacctggtaagtagcttatttgggaatttgaactagacaacctgaccccatagccttggcttagttttaactaccacattgtgcctcttcccaccaagtgagaattctgtgatacaacaccgtgaaattttatcgttagtgatttaatccctagaaaaattttaaatggctatttataaagaatttatacatctataagctttctcttttttaaaaacaaaaacaaaaacaaggtttcattactgtcacgcaagctggagtgcagtgatgcaatctcagcttactgcaacctctgcctcccaggctcaagcaattttcccgcctcggcctcccgagtacctgggattacaaggcatcctgcaccacgcctggctaatttttttctgtttttagtagagatggggtttcaccatgttggccaggctggtctcagactcctcagttcaagtgatctgcccgcctcagcctcccaaagtgctgggttcacaggcgtgagccactgcacccagtctataagctttttaaaaatgacttcatgagataacatagagtggtatgattttgaaatatctcaaatatggatgagttaaatttatcacatttctgccatgcatgtgcacgtgtatgtatgcatgtgtatatgaaatcatacaacttcagggctgtgtaggaaactctggagccagttacagtattaagccaacccttttatttgcagatgagaaaactgagacccccaaaaatagtaagtgacttacttgtaactttgatttttcatttctgtggtttctgctactaactacccctgtgactttaggcagatccttgaacaatcctggcttcagtttcttcctgtgtaaaataagaggtttggatgaaccccaaattctttccgttctaaaaagttgtgtttttatcattctttcctttatcttttcaagtattctttgggtgaaacgctattttataaggtgttaatgaggccaacagtgtattcaaaagtaaaaggtcctgattaagacttggtagtgagaatattctagctttgtagctgtgacattttcttaacatttcttatttggcttcctcagggcatcacatattatatatcacgtaccacatattgtttcccatgtgtaatctatacttgtccctttatttatttttgtgtgtgtgtgtgtgattcttctttgagcaatatacttagttattttagttacagaaataatacctgtttattgcaaaaaaaaaaaaaagtactgttgagtacagggtagaaaataaaagtccttcataatcccactacccaaaaataatcacctttaacaattttatttacttattttttttttaatagagacagggtctcattatgttgtgcagactggtctcgaaccactggcctgaagtgattctcctgcctcccaaagtgctgggactacagagatgagctgctatgcccagcctaacaattttatgtgttttaagaaaaaacacagatttgagatcatgtaacacctattgttgtgtaacctcctcctcacctacccttgcccctccccccaccaccccagtaagagtgttataaaatggcttctgttcttcctgtggtgatttctgtaaagaggattttttttaaggtaaagccataagtttaaacatcattgagcagatccagcatttggctatcctagctcttcttcaaaatgtcaggttttcttttgtcatcaccaccagcaggactattattctaggatcctagtcatcatgccttgtataaatcaaacaaaaatgccacactagcaacaagattggtttactctcatagctttccttctatctgatgtgctcagaaaagatctgcttaatgcaaatcatatttcctaattaatctctttataggtaagtgttcattggatgggtgtacctcgtttttaaaaggagaagcaaaatgttatcagcatttgaggtatatagtatttgcatgaagtgtcttactaacagccatatgccaggtgaccattgactaatttcttggtatctataagcctacacttcccagctgtaatttgagagtactacaagtatcttcttcctaaggatgtaaagtgcttaatactgtgcctgccatacaagtatgtattcgatattgttttaaaaattttaaaaaaacaggctgggcacagtggctcatactattatcccaccactttgggaggccaaggcaggaggactgcttgaggttagaagtttgagaccagcctgggcaacatagtgagacccccatctgtacaaaaaatgtttaaaattagccgggtgtggtgcatgtgctaggaccacaggtcctacctacttgggaggctgaggcaggaagatcacttgagcccaggagatcaaggttgtagtgagccatgattgtgccaccgcacaccagcctgggtgacagagtgagagcctgtttcaaaaataacctcgtattgattttagcttaacttcaaataactttcttcttatgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagtaagtacctcaactcagcaagcaagctctttccattcttacacactagcggtaattgtgaccctgaataaattacttaacctctcagaccctcaatttcctcatctgtgcaatgtggctacttatacttaaaacataatgtttgtttacttctgaaaaacacagcctaatagtgatatgattattaatgtgattatagatccctatgaagttggtcactggcatcacattcgtaagtatatctaatcaacgtttaccatttcatggccttttaaattatttaaaattcagcagtgcttcagtaaaacaatgaatgcatctaacatttaagtacatactttaaattgtatatcggtcttatgaatatgattctgatgctgatggtccctggaccacactctgataaccactaatcaatgtaaatggctcctgcaaatggagacttaacactaagactaaagagcttaatttgaacatgtgcttcttcctactcttcctcacaaccctccagcatgaaaaaatagttaaaacaaaatttcgtaattgttttcagccaatgccctttgttaacattgtcataagtacaaaattattttgaatttatagttttttttagcccagctttctccagaatggcaaggtttactgtaaagctctataaacgtatagggagatagagaatctttgtgcattatgtactctttcagttataaatgacagaattcactttaaattattttaagcctaaaagggaaaatattgagctcagctaacttggacagcgaagaatagcattgatttcaggcacaactgagtccagttcaaggttgcagagttcccagagttctctctttctctaccttttggctttgcttatggccgctcaattttatgtattggtctttatctttctggccacaaagtggttttcttcaccagggttgaaagaaagccactagcctctctaagccttcatctctgtagctcattatccaaaaggtacagttgttcttctaggatccagtgttaaccctttggatcaatctccggggcaatttctggatcagtcgagggaccatggcccatgtttattgaggcctggttcacatgagcatcctgcagctaagtagcagggatggctgtgaatacaagtgaacaacaatcccagcagggaccgtgtgggacagaggagatgccacatctgcccccgtggaaagagagccactagacaagcaaaaacaatagctagtgattaatgtgttagcctgcctttaaagaagtatttctgatggcataattttgtattcctctaaaataagttgtagtcagagtaggccagtacccactggagaagaagtactttcttgagcagcgggggtcagtgccctcaccatcaattatagtaccttaatctgctttaacaatacagttaaaaaaaaaaaaaacttttctagtaactgcaagtccttcgaaagaacttgaaattgtaaagggaaagtttatttctcttttaatgctaagatcacccttaacggtaaaatggagtattgagctatttctaagaagtagattttggcagtctttttcttttttcctgctagaatagcatgtcttcacttgacaagaataatttttagcatatttttcttacgagaattaaagcgatttaattctttcaatgtttgagccaaaagcacatggtaacatagtattgcaaccaactgtaagacatcccagattattttccctctgaatatttgggtaccatttctcttcttttttttttttttttttttcttttttttgtggcagagtctcactctgttgcacgggctggagtgcagtggtgcagtctcaactcactgtaacctcctcccaggttcaagcgattctcctgccttaacctccccagtagctgggattacaggcactggccaccacgcctggctaatttttgtatttttagtagagatggggtttcaccatgttggccaggctggtctctacctcctcacctcaagtgttccactcatctcggcctcccaaagtgctgggattacaggtgtgagccactgcgcctggccctgggtaccatttttcaaactgtgtggaacctgattctgcaagatatcagtgcgttcccaccacttccactgctgaaaaaatgaccctttttttgtgtttagttcatagacatactatcgtcaacacacccctcttcaagattcccaatgcacatggacatattaaagaaacatgcttactcttgttatactcagattttcctaaacttagataaccatgggaaaccacccccccttatttttatggaacatctcttaacattttgagggattagtgtttcaaataatacgtgttagcaaaacactactttagtattctaaatccaaaacactaactttagtattctaaattataacacttttccagttttgcctataatggagaagtcatataactcatctcaaagaaaaataattttatttgtaagttgcttcaagatcgttatagtatctctataaatttttattgtatttctcaacattgtagtttaaataattatatatcttaataatcttattttcaatggattttctttacctataaaagtatgggtagtgagatttttttaaaatatgaattaaatatttgtatatgggaaagagatttccaaaaagccgttgatttttaattgtatttgtggatgcaaagaattcagtgaacggagatgcatactgaagtcccagtcctgctttttttttttttttcccctcgtaggctattattcgtgaattgggtggtattccaattgttgcaaacaaaatcaaccattccaaccagagtattaaagagaaagctttaaatgcactaaataacctgagtgtgaatgttgaaaatcaaatcaagataaaggtaagttgactgaaaatcacaaatgtataaggttttctataaataaaaaataacaaaaagatgagtaatgaaactttagtagactatcctttgtaattttacagccaaggattacctttagaggaatggagaataagacagaagagggagggacctgaactagccaataagaggtacaataagacttttgtttcagtaaaataatgcttgtttattctacaggttatcctctacatcagggacaggcactggtgacagtaatagccttaaggctataggcaccaaccaaatagtgaatatagttggctgaaagttgggacaagactttgcgctagaactagaactagtattacaagagattcattcagggagcatatccgatgctacatattcataaatatggttgttaatgcatacagtttggctagttttgcctttgaaattaagtgtactgtatgagtgtattgcaaagtgttaagtcactgtatgctttagctctttcaatggatgaggcaaatgtgcaaatagattaaactgacttttacagaataactgttcctttatcttgttgtatggggagaaatcctccattttaggatgcacataaaatgctaacctacgttactgacattgctttaatgctttttcaaaaatgttatttatgaggcagttaacctgtaaaaaaaatagttaacttggtaaatgccaacagttaaaacacttcagccatggcatatatagccagaacccagtgataccccttggttatagaaaagagcagtgttttatgtttattattgaaacaggactcccatgttcaaactagaaattgtcattcaacagaacaaatcaggtcaagacaatcacgaaacaagagacaggaggatgtgctcctatgaagaaaaaaacaacaaataaccaaactttatttccttgaatataatgttgatggcaagatttgtaagaggtaatctctgtatttagtttagataaagacttccagcccaaaacactgttaagcagtaactgtgaggagctatgcagaagtgatgagaggcaagtactatatagactagaaaatttaattttctacagaattacagattactatgctatgaagcaaaagcagaccattcttaatgtatcaaattggtgagcttattaatttcaataaaaatatatgacccccatcacacaaacaggtaactctaaatctactttgaaaatctgatcagtcaagaagtattaccagtttggaggctatgtaccaagtgtcataccaaagataaggctgctgtcctcacagaatatatggggtcattgacaatcaattagaatatccaatgaagtggatattctaatatttggagaaatattggaaaactagcaaagtgccctggaaattatgtgttcttgcccttccacaagacgtatagatccagatgagattagtttggaataggggtctttttttagtccagaaaatctttagagtccaatacagttatggctaatcagagactaaagaacctttatgaaagtaagtaggattggaagtccttggaaattgagaacgcttattttgaattagcatgttttaatcaaaggtatagaattaatcaagtatcagttaagaatttctggaatgcactccaatgccagaagaccactagcatgctattttgtactatgaagatttcctgatttgaaatagaaggtaaaaaaaaatattgccagccataaaataaattttactctacttgcttagttctccaaagaaaaatcttacttttttcccataagaaactcactggatcaaatgaatgttaattaaacaaaagattgtgtaagtaaaactgggcaaaagacaacctctgaaatccatgaaagaattaatcatcaaaagagaagaatcatttttacagtagccccattgccgtgagagatattttcatgagcctgggccacctctccaacatatagtgagaacttattacaggtttcagccaaccaatttccattccagcttgacaggctgctgcaaattgctgagattcctccttggttgaggaaaatagagtaacgacaattttactagactcttttgccatagtgtcccatgggtttatttcaatggtaccactgttgccaacacctattacttatcttccatatgacaaacaattcgcatatttactaagatttatattagctattatttcaataatcacatcaattcctttcttatcacacatttcttaattttatcaacatagttaacttctttgtaattaaacactttgtgggctccattttgcaaaagtctttttgtccctcagtaccaactgtgcccaaaacctttaagacataaactctagcaatttggcatgttgctactgcagctcctccactagccccatgaaccagaacactctccagctttcatacagacactgtgaatcagagctcgatatgcagtaagatatgggataccaatggcagcattttgtttaaagtccagtttttcaggcagtttgtaaacagcgtaatctgctcccagagattgtgccggtagtgaaaactgtcacttttcttgaaagtagatgcattccctccaacagcttccgttaccccagttacatctgagcatagaataaggtggttttctattataaataccagagtaaatgtatgtctccatggggttgacaccacacgcatgaaccttgattacaactaatggtcttttggaactggtactgcaacatctgactgagtttcaggacttctggtctaccaaattcaaacactctaacagctctcaccagcttttgttcagttgccatggtcatctagataaaagctctagagtgggaatcaaaatctgcaagggctccttcatattccactgaaggaggctggccaggctgcttctaacttttgcagccaacaagacttttggagttggggttcagtttaatctaagggtgctaaaggaaccaggccagggtcagataatgtcagcagaaaaatgcaatattaggaaattatgttatttcaattcaatatttatcaaacctcctgctttgtggtgcagagtatacaaatgagcatgatgcaactcttgttctaagaaaggtggaaggaaggataaggcaagtccttaaataattgtaagtcaaggcagaacataatgaagtcctttaaagaaaaatgtaagtaaaacatgattgagtacatagaaaggagagatttcatccaaaagtttctgtaagaggtggagtctgacctggctcttgagaatgttaccctacaggtagagttggggaaggagagaattccaagagaacagaacaagatgaggtggacacagctgcaggaataactaagctggtccatttggtaatcttgttattataattgaaatggtaaaaagattcagatataataaggatgtaaacagtccacacattttaggaaatgccttgaaagacatcagcatcttacagaagtatatgatttataaagagctaaataaatgccatgtttttaaaggatggatgtataattaaattgtaaccaaagagaaccagttgactttcaaatgtaaattagggccaggcgtggtggctcacacctgtaatcccaacacttgggagccacgacaggagattgctggaggccaagagttcaagaccagtctgggcaacatagtgagaccccatttctttatttttgtttgtttttgttttgagacggagtctcactcttgttgcccatgctggagtgcagtggtgcaacctcagctcactgcaacccctgcctcctgttcaagcaattctcctgcctcagcatcctgagtagctgggattacaggtgcccaccaccacgcttgcaattttttgtatttttaatagatatggggtctcaccgtgttgaccagtttgggtgagaacccatttctaaaaaaaaaaaaaaaatttattagctgggcatagtggcatgcatctgtaatcccagctactcaggagtctgagacagggggaatttgaggctgcagtgagctgttatcacaccactgcactccagcctaggtgacagagtgagaccctgtctctaaaaataaatgtaatttagatcttgaaaccagattaaaagtttaatctctcattgctttactgccatttagtttctatggtaacatggatacatttgggattttttttaaattaataattgtttatgggacaattggtaacttaccacttcaaattaggaaaattttcttagcagttagaacttttggtggagttcagatttgcttaagtgattagtagttatctgtaaaacataatttttgtaagctagaaagcttatggccaggccggacatggtggtgcacacctgtaatctcagcactttgggaggctgaggcaggcagatcacttgagctcaagagtttgagaccagcctgggcaacatggtgaaaccctgtctctacaaagaatacaaaaattagctgggcatggtggcattgcagcctgtgcggcagtgagaccttgtccccccggaaaaaaagaaagctcatggccagacacagaaagtagagtttcagaaaagtttccatcacactgagtttagttgtgtcatgtatgatacaagagtactacagcattgcattactttttaccagtgatagttaacaatattatgaaggggtgaattatatatatatatatatatatatacacacctaggtaaataagaaccttaggccaagtataattttgttctgcttacttttgataggattaattctagggaaagattctgtttcacattatcctcccattctttacttctgaaatgatgtagctctctagaccctactgctaaggtacttattactatgatacaaaatggcctcacatcttcttccctgatcccagtgtgcgcagaccgcagaccagttgaaaccgaaaggtggactaagatgggaggcctccaaccagggagaagccactggtgttaacagcatgatctctgggcttggctattgcatccccacctgctgtctgacattgggcaggggacccgagctctttaaagacttaaaagtccttgtctgcaagatagccgtaatagtacaacacccaactcattagagttgtcttcaggattaagtgaggagtatttgtaaaatgctaagcactgtgcctggaattaccaaaggaagcttttaaaaagtcaacaacttttgagggccagatagaaatttcatattttggccgggcacagtggctcacgcctgtaatcccagaattttgggaggccgaggcgggcggatcgcgaggtcaggagatcgagaccatcgtggctaacatggtgaaaccccgtctctactaaaaatacaaaaaaattagccgggcgtggtggcgggcgcctgtagtcccagctactctggaggctgaggcaggagaatggcgtgaacccaggaggcggagcttgcagtaagctgagattgcgccactgaactccagcctgggagacagcgagactccgtctcaaaaaaaaaaaaaaaaaaaaagtcgtattttttgaggagtcggttccatcctgagcagtagccctactccactgtgcagaaaagtggctgttcagtagaaaaattttggagattctaagatgctcattttcctcccctgccttcagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtatgaagagctattgtgtcaagcttattaacattgaaatagtatttgcaggccacctatcttaagttgatgtgcctcaaagaggaagatttattaaaaactcacatgggcccaagaaagtatattatttttagtcccaaatattccattgcaaaattaacttttgaaaaccatctgttgtttcacttatcaacagattcctgttcatttggttttctgagaagctagcttccccccaccaaatataggaacattgtgattaaaaggagtctgagtaatagtagtggttagttgaatattttgcttacctcagggttaacaaatcatttttttgattcagttatttgttgaaaaatatttctaaaacaacttttaagctgtagtaaatgaagtgaattgaatatatgaaagatgtctcagtgcttcactctgtccagttaggttgatataagaggcaacagatattgagctgaattaagtaggaccttaggagatgccctataaaaagtttcttaagtaaatctctcatattagtgtgcattcttatcaattgccatttttcaagaaaaagtagcataaaaatagattgtaggctaattaaaagttctgataagtcgggttgattgttcatcaaggctttttaccatgttagtctgtgttctctggaacagttgagagacaaatgcataagcattttagaaagaccaaatgtgaagccatactccaaatattcaacatcactgcagttatttttgagtttatcaagatgtgattacaggagagtcttactgtagtcctgcttttatgtttccaaggtgtttgtacatggactttcctcttttccaatagccaaacttgtttggatgtgatccaagatgtaccaaaaggtattgaaaattaaatgtaagagtagtcttctagcaatattgcaccattcccaggcagtttccaacgtgcatcagcatgtctgtctccagtggaacaagataacttccagcccctgaacccctggggaaactccttccctctttactgtatgttgttgccactgtaggagaaatctctcctctgcctgactctgcagctgctttacccagaacctcaggaggaactctgagtccagagccaggctgagttcagccaggcaagtctggccttggggctgtatatatctgtctcagacatcgtctgtgttttcatatattttttgactttttaaaagatgacccagaccacaatagtatgttctatttttgttttgttgtgttgtgtttttccattacattgcttagtacagtatttctaggatagaaaatttgctttcttggtctgccttggaacatacctaccaattacaacattgattttccataaaaattgagtttaaagttccaacttgcaaatgaacttttggatagccatccatttgttagtgggaaagtgtgtctgatttaggtattttcttagtaaataaccactaaaatgaatgtttaaatatcgtattttgcttaagtcagggatctcactgtactgtaataaccgtttgggtacaccactgattgataacttaatgcagatagtggaggattaacataaactgtgtgcttgttacatcctcaatgaaaacaaaactaatggtttaaaatgtcctagtgtcaccacaagatggtgcatgtgacgaggaaaaaaaacatgtcttaatatggtttcaaaccaaaatccatatatttgtttaatctgtagttgtactctaactgtatatatatttttttctcatatttaactcccttctacaaagaatagcaacatcagattttaatacaggataccaaatagctattgctgttgctattccctggttgtatacctgccctcattgactattagtgggtcttagattttgacttcatccaggcttatttcgtaagttcaggaccatcctatttcatacctcctgttcctatttttctaattgaaacttcattgacattggagccaggtgtttttttcctaacacttattcctagtgttgctgatagtcagtcaggccagatgagatctgatagtgacctccacggagtgcactaaagaagggtcagaagtctcctttactctttcaaccccagaggccttaatttattaatagcatctctttgaaaaagacaatctctgcatattcaagaaatgttaccagtggacactgctgaggattggaaggggccaaaagcatggtggcttttgtttttaccttgttctcttttgcattacttaaaatttttatcatgaccaagtagtaattttctaaaaataaagaaatatttgataaaaacagtaaaattaagcaaagtattatgtcatcctcaaataaattagtatctacaacatgatcaaagaaattgtgactatacaggatatttgcataaaagaccaaaaagaaaatactaaaacttttctttctcttttttgacacagaatctcactctgttgcccaggctagattgcagtggcatgatctctgctcactgcagccttgagcttccaggctcaaacaatcctcctacctcagcctccctgggactttggtcacatgccaccacgcctggctgatttttgtatttttggtagagacggggttttgccatgttgcccatgttgctcttgaactcctgagctcaagtgatctgcccaccttggcctcccaaagtgctgggaatgcaggcatgcgccaccgcacctggccaaaaataccaacacttaatcgtgatcatttctggttatgtaaatacgggtaaattttctttttctttgtggttttctatttttttgaaagtgctatggtaaacatctgttgcctttgtaataaaaaatttttctaaaataatatccaggttccttcccagctctagtgaagagcacatttgtcccatttccctgagttagtacccccctctatgcttattttagttccaggtatcttgtagaaagtatggtttcacatggcctttgtttttaaaagacttggaaccaacccgaatgtccaacaatgatagactggattaagaaaatgtggcacatatacaccatggaatactatgcagccataaaaaatgatgagttcatgtcctttgtagggacatggacaaaattggaaatcatcattctcagtaaactatcgcaagaacaaaaaaccaaacactgtatattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcaccagcatggcacaagtatacatatgtaactaacctgcacattgtgcacatgtaccctaaaacttaagaataataattaataaattaaaaagaggcattctatttgagtcttgttattactgacttttcagttataagtgataagaatgctgatattttagctagtcacccattagataacatttatttgcttattatttatatcattgctgggcatggtggctcattgcctgtaatcctagttactttgggaggccaaagtgagaggattgcttgaggccaggagttcaagaccagcttcagcaatatagtgagacccccatctcaatcaatcaaccgatctatcagtttttatcactgtgcttatttatatgattgtaaaacactttcacattaaaagataacctcaaaaattcatggtagcttaccaaaaggggccatattgttatttatttagtcttggtaaccaaacagttccaaaatttttactgtttaagtagaaatgagctgagctttgagagatttttttgttgttgttttaaagattatatttctttatttcttttttgtcgggggtgaagatggggtctaagggtctcactatattgcccaggctggagtgcagtggctgttcacaggcacaatcatagcttactacatccttgaacttgaacatccttgagatgggaaggctcaagagatcctcccccgctcagcttcccaagtacctaggactacaggccgacaccatcatgcctggccatacttcacttaccagtaatcataatgaagatcgtgtatttaacagatgttaagcttaccaactgttcagatgtgcatgtgaattgggggtagattgtgaagacatttgcaatattctatctccctgacattataattgggaaaaattaggtttaaataaccgtgtgatagaaaacctgtatctctgtgataagttctctaagagtggtacaagacatttgcaatattctctctatctccctaacgatgtaattggaaaaatgaggtttaaataacactgttctatgataggttctctaagagtgctgccaagtgttataagagttcagaatgagacctttaaagtagaatgaacggagaaggtttcctggagtagagagaatttgagccaggcctggaagcttaggcaggactttaacaggaagacatggtgagagaacagcatgcctgagagagaaaattcatgcttgccagtctgagataagccagtatcatcttctttcaggtgcaagttttgaaactgcttttgaatttgtctgaaaatccagccatgacagaaggacttctccgtgcccaagtaaatagcttatatatttattttgtaaatatacacatatatacatttgaacagacagacagatctggaaagattaagcctaaaatgttaacagggattctctctgaggagcagtattaaaggtggttttttaaattcattttgtatgtgtaaatttcctaaattttttgcaatgagcctcttttacttttgaaaaacatttttaaaaattcaccctagcaacaataaattataacttttttctctacccaattttgggtacaattgtgccatcccatattttatacttgaactgtttgtgtttacatgtatcttagtatccactgaaacagcagtactgagtccccagcatatgctagatgagacacaccagtgagcacagcgtgacatggtacatgtcctcacgaagcttacagtctagtggagagacaaaaatatataacaagtgaacaaggtaattaaaagctgtgataagtgttctgaatgctgggatagaatggagctccactcctgtagaagaggaaccatcgtattcatctgctcatccctattccccacccagctctgtgccctgtggtgtatgggcactaaatgtttgatgaaaaaatgagttcccatgaaaaccgtatgatgatcttaaaaaagaaaatggttgtttttcccaaataaccacattctaaaattccaaggaaattgtatttttccagctgaaacactcccttttttccattagtattacagcgtgggggtacataaggttttatacatctaagttatgaaattttgggttttctgtgacaaaatttttttaatgtgagatacattttaaatgtgaatttaaaaattttaaaatgtgagttattcaatgtagttttaaaatgttaaaatatacatgaaaaagttttcatatattattaatataaaataatactcattgtttcatatttcaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacggttttttcaaatctacctccctatttaatgaaagcatattcattaaatatgaaactatgcatacattaaaaaccaggatttgtttttaatgtgctttagcagcagtagattctaaaactgtgtcttcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtattcctcagttatcacaggaaacttcaataaaatcttacatattgctatgggtattcacgaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagcactggtgacttgtttcaggttacacaaaaaaatccatgatgaaagcagggtaaaagttcagatttagtggctaacgtggcaccacacatacaggtgtgcaaataaattatagagcactgcctgggtagcatttggtgtagaaaacctattttgattattttgtatgaataaagtgctgagactggattaggaatacagaatgggcctccagtggtatctaatccacctccctcccttaggaagggtcagaataatcaagtgaatacagagtccttattaggactaaatcttatgtcaactgactccccccccgccccccaaccactggcattcatactggcttaccaaaagaatcatgcttaaggttcatttaatataaaaatgtaagacatctgaatcaggtaaaaaaaattataaatctgattgatatatttagagctaagagactccaggaaaaaaaaaatgtgtagagaaaattaaaaacaaatttaattcaaagaatatggtctattaacattttgtctgtaaaatatttcattgtagctgtatttgtgcttagaagatcttctagatttaaaaacagaaaatggcataaatcatattctcatagccacactccttcccttcctctgctcagctaaggagagggctttcttttgagacagggtctcattttgtcgcccaggctggagtgcagtggtacgatcacagctcactgcagcctctatctcctgggctcaagtgatcctcccacctcagcctcccaagtacctgtgactacaggtacacaccacctcacccggctttttcttttttctttttttttttccgagagagacgggaggtcaccatgttgcccaggttgatgtcaaactcctgggttcaagtgacccacccaccttggcctcccaaagtaagaggtcttttgggaattgtagacgtgcaatagaatatactgttccctctcatctgaaggctctaggaaaaaaagaatatactgttcttttaaaaatttaagtgaatggtggtcatgggtgcattaatgcgaaagaactgtacacttaaaaatggttaaaatggtaaatgtttaaaatggcaaatatgtatttatatattttaccacaatagagaaaatcaagtctttaaaaatgatagcccctatgtttttatgcttacctaaataaaccatatttaatatttggcatataagctaatttgatagagcaagaattgctatgtttataataagcatgttggactgaatttcatcatttattagaatgtgcatataagaaagatacttgtatttgtaggcctctgaaaaacatctaggtaggtagagagccttgactcaccttgccgaaggtcctgaagaatggaaaaaagaaaaatgaatcttcaatatcggtttttcacctcaggaaattctagtaccacaaaaatataatgttttagtaaaaacatttccattgcagtgcttatatcatgatatgaaatttaaaatccacattagccaattcattatttaaatgacccacccctgaaccctctcatagtgtacatgagctgatcatactaggaagcaagttattacacaaaacataaaacataaacttgcagaagttgtttccaaatgtaaaataatcacaatattcatgaatttctaagtcttttcatttgtttttaaacttagatgatgcctttttcattaaaagtgcctgtgctcacatttattaaaagttttcatcatcattatttaggtatcttgattctccatgcttcaagacaaaaaaatcttcagcgttaagtccgtatctctctagagcttcattcagcttcactggaggctctaagtaatgctggccaaagagaaagaagaaaaatagaaaaagattaaacatatatttgggagattttccaaataacagttcaaactaaaataaccaacagatgcctagttagaattaggccctttcttttaattgaagcattagcaaatgggtctatcacattttctaatacagttttgagtcatgaattaagtcaacaggtatttggttggatagaaatcatgccaacaccatgtatgtgaaatttggtgccatcttactttgaacatcactggattgcatgaaatcatcacggtttcaccatatgaaattccaatctagatggaatcagtgccaaagatgatgttattagagaattacatgttactaacatttttgaaaaatatagaaatcaaattgtggtgtgtgtgtgtgtgtaaccaaatgctagagcaaattgttttgctgaagaagggttgttatcctcaaaaagtctagtcacatacagaaaccacagtctacagaatgaaagaggatcccagagaatatgaaggttgagctctgtgtggcaaagaggagtcaagattttgccctgaggaattgctaaatgggagtcaccctttactgagatgtttgaaaagtaagcttgagggaagatgagaaagtttaatttcagactttagttctaggtacctaatggatatccaagtggagatgtgaaggagacagttggatatataaatgtggattatagaagaaaaacatctgagctagagaggaacagcaggtaggtggtatttgaagccataagactggatgcgattcccaagggagaaaccaactacagaagagaagaggtccgtggactgacttctacggcacgcactgttcagagcaagcggagaggagggactagcaacagagaataagggacagccaatgatgtgcaaggaaaaccaggcaagtttcctgagcccttaaatgcacaggtttggtaacagttgttggccacacacaggtcatccttttcccccttgctcagttccaggttttatggctatgtttaaagataaaggatacctttcaactgactactgagtaagtttggttttaactgtatgctggttatccaatattcctagagctaaccccttagtaatggatagttgataacaggaatttacttttagtctattttatatataaagaaaaaagatcactaattatattacaaataaaatttaactttataccctaagtcaagaaatttcccctgaaataatttcctaaattattttaagagatttcaaaatgatgagcttttttcccattgaaaaataacttcttttgttaaattctctttctcccatgctgtacaagtctgggctaacagtacacactcacagaatcaccctacgtcagtaacttatttgctaagctataactttagtgtggagggcgatgtttgcgtttagtgagaattctgatatgttagagttggcagtagaccctctgtctttaatctgcctagatttagcagtatctttctgagtttcttcacagaccaattcttcgctgtttcaaccatctggaagataaccctggaggtaggtctgaaaggcttctgagtgactgagagctcacagtccaagcactttagtccagaagggagataaaaatgccccataaccatgggacaaaacaactacatataaagcaaaacagcagatcagagatcaatatgagtaaatgggaaaagcagaagactccgagcattctggatccattagggtctaggcagctagccacacacaactcgtaaattcctaaaggggtcagtttcatgatatacaacaatagaatatattcaaagtaaagacccggatcacttgaaaggcaatgtacatattatgtaatgcttgaaactcgtttccatcaaaactagtaatttaagttttagtgcttaaatatatgtaggaaatgcactcatcattccctagataaattagatgttgccatatatgcaattttagagtattgccaagttaaggacatccttaatctgcttatattacacgaggcagctactataacagcatatatgcaaagagtgttaaagtgtttagaagtcatgggtaactggctgggtgcagtggctcacgccagttaaggctgaagcggacggatcacctgaggtcaggagtttgagaccagcctggccaacatggcaaaaccctgtctctactaaaaatacaaaaattagccaggcatagtggccggcacctgtaatcccagctacttgggaggctgaggcaggagaattgcttgaacccaggagacggaggttgcagcgcgccgagatcgtgccactgcactccagcctgagcaacagaatgagactccgtctcaaaaaaaaaaaaaaaaaaaaaaaaaggctgaagaggaacagctctggtctgcagctcccagtgaggtctacacagaaggtgggtgatttctgcatttccaactgaggtacctggtccatctcattagggctggttagacagtgggtgcagcccacggagggtgagccaaaggagggtggggcattgcctcatccaggaagaacaaggggttggggaattctctcccctacccaagggaagccatgagagactgtacggggaggaacagtgcactccagcccagatactgcacttttccaatagtgttcgtaacaggcagaccaggagattacctccggtgcctgccccaccagggccctgggtttcaagcacaaaactgggcggcaatttgggcagacaccaaactagctgcgggagctttttttttttttcataccccagtggcacctgtaatgccagcaaaacaaaaccgttcactcccctggaaagggggctgaagccatggagccaagtggtctggctcagcggggcccacccccacaaagcccagcaagctaagatccacaggattgaaattttcgctgccagcacagcagtctgaccctgacctgggatgcttgagcttggtagggggaggggcgtccgccactgctgaagcttgagtaggcagttttcccctcacagtgtaaacaaagccactgggaagttcaaagtgagcagagcccactgcagctcagcaaggccgctgcagccagactgcctctctagacttctcctctctgggcagggcatctctaaaaaaaaaaggcagcaccccagtcaggggcttataaataaaactcccatctccctgggacagagcaactgggggaaggggtgctgtgggcgcagtttcagcagacttaaacgtccctgcctgacagctctgaaaagagcactggttctcccagcacagcgttcgagctctgataagggacagactgcctcctcaagtgggtccctgacccctgtgtatcctggctgggagacacctcccagtaggggccgacagacatctcatacaggagacctctggctggcatctgacgggtgcccttctgggacaaagcttgcagaggaagaaacaggcagtaatctttgctgttctgcagcctccgatgttgatacccaggcaaacagggtctggagtggacctccagcaaactccagcagacctgcagcagaggggcctgtaagaaggaaaactaactaacagaaaggaatagtatcagcatcaacaaaaaggacgtccactcatagagcccacctgaaggtcaccaacatcaaagaccaaaggtagataaatccacaaagatggggagaaaccagcacaaaaaggctgaaaactccaaaaaccataacacttcctctcctccaaaggatcacaactcctcaccagcaagggaagaaaactggacacagaatgagtttgatgaattgacagaagcaggctttagaaggtgggtaataacaaacccctccgagctaaaggagcgtattctaacccaatgcaaggaagctaagaaccttgaaaaaaggttagacaaattgctaactagaaaaaacagtttagagaagaacataaatgacctgatggagctgaaaaacacagtaagagaacttcattaagcatacacagtatcaatagccgaatcgatcaagcagaagaaaggatatcagagattgaagatcaactcaatgaattaaagcgagaagacaagattagagaaaaaagagtgacaagaaatgaacaaagactccaagaaatatgtgactatgtgaaaagaccaaatctacacgattggtgtacctgaaagtgatggggagaatgaaaccaagttggaaaacactcttcagaatattatccaggagaacttccccaacctagcaagacaggccaacattcaaattcaggaaatacagagaacaccacaaagatactcctcaagaagagcaacctcaagacacataatcgtcagattcatcaagggtgaaatgaaggaaaaaatgtaaagggcaaccagagagaaacttcaggttacccataaagggaagcccatcagactaagttacccataaagggaagcccatcagactaacaccagatctctcagcagaaaccctacaagcccagaagagagtaggggccaatattcaacattcttttttttttttttttttttttttttgagatggagtcttgctctgtcacccaggttggagtgcagtggtgcagtctcagctcactgcaacctccacctcccgggttcaagcagttttccagcctcagcctcctgagtagttgggatcacaggcgtgcgccacaacacccagttaatttttgcatttttagtagagacggggtttcaccatgttggtcaggctggtctcgaactcctgacctcatgatctgcccgcctcagcctccaaaagtgctgggattacaggcgtgagccaccacgcccagctcaacattcttaaaagaattttcaacccagaatttcatatgcagccaaactaagcttcaaagcgaaggtgaaataaaatcctttacagacaagcaaatgctgagagatttttgtcaccaccaggcctgccttacaagagctcctgaaggaagcactaaacatggaaaggaacaaccagtataagccactgcaaaaacataccaaattgcaaagaccatcaacactatgaataaactgcattaaccaacaagcaaaataaccagctaacatcataatgacaggatcatattcacacataacaatattaaccttaaatgtaaatgggttaatgccccaattaaaagacacagactggtaaactggataaagagtcaagacccatcagtgtgctgtattcagaagacccaactcatgtgcaaagacacacataggctcaaaataaagggatggaggaatacttaccaagcaaatggaaagcaaaaaaaagcaggggttgtaatcctagtctctgataaaacagattttaaaccaacaaggatcaaaaagagacaaagaagggcattacataatggtaaaggaatcaatgcaacaagagctaactatcctaaatatatatgcacccaatacaggagcacccagattcataaagcaagttcttagagacctacaaagagacttagactcccacacaataatagtggaagactttaacaccacattgtcaatattagacagatcaacgagacagaaaattaacaaggatatcaaggaactgaactcagctctggaccaagcagacctaacagacatctacagaactctccacccccaaatcaacagaatatacattcttctcagaaacacatcgcacttattctaaaactcaccacataattggaagtaaaacactcctcaacaaatgcaaaagaaaggaaatcataacagtctctcagaccacatgcaatcaaattagaactcaggattaagaaactcactcaaaaccacacaactgcatggaaactgaaaaacctgcttctgaacaacctgctcctgaatgactatgggtaaataacaaaattaaggcagaaataaagatgttgtttgaaaccaatgaggacaaagacacaatgtaccagaatctctgggacacatttaaagcagtgtgtagaggaaatttatagcattaaatgcccacaagagaaagcgggaaagatctaaaatcaacaccctaacatcacaactaaactagagaagcaagagcaaacaaactcaaaagcgagcagaagacaagaaataactaagatcagagcagaactgaaggagacagagacgcgaaaaatccttcaaaaaaaatcaatgaatccaggagctggattcattagccagactaataaagaacaaaagagagaagaatcaaattgacgcaataaaaaatgataaaggagatatcaccactgatcccacagaaatacaaactaccatcaaagaatactatcaacacctctacgcaaataaagtggaaaatctagaagaaatggataaattcctggacacatacaccatcctaagactaaaccaggaagaagtcaaattcctgaataggccaataacaagttgtgaaattgaggacgcaattaatagcctaccaaccaaaaaaagtccaggaccagacggattcacagccaaattctaccagaggtacaaagaggagctggtaccattccttctaaaactattccaaacaatagaaaaagagggaatcctccctaactcgttttatgaggccaccatcatcctgataccaaaacctggcagagattccaaaacctggcagagacacaacaaaaaagagaaaatttcaggccaatatccctgatgaacatcgatgcgaaaatcctcaataatggcaaactgaacccagcagcacatcataaagcttattcaccatgatcaagtcagcttcatacctgggatgcaaggctggttcaacatacgcaactcaataaatgtaatccatcacataaacagaaccaatgacaaaaaccacatgattgtctcaatagaagcagaaaaggccttcgacaaaattcaacaacccttcaagttattcaataaactaggtattaatggaacatatctcaaaataataagagctatttatgacaaacccacagccaatatcctactaaatgggcaaaaactggaagcattccctttgaaaaccagcacaagacaaggatgccctctctcaccactcctattcaacatagcattcgaagttctggccagggcaatcaggcaagagaaagaaataaagggtattcaattaggaaaagaggaagtcagattgtctctgtttgcagatgacatgattgtatatttagagaaacccatcatctcaacccaaaatctccttaagctgataagcaacttcagcaaaatctcaggatacaaaaatcaatgtatcacagcattcctatacagaattaaaaatcacaagcaaactcaaaagcgagcagaagaccaataacaggcaaagagtcaaatcatgagtgaactcccattctcaattgctacaaagagaataaaatacctaggaatacaacttacaagggatgtgaaggacctcttcaggaaaaactacaaaccactgctcaaggaaataagagaggacacaaacaaatggaaaaacattccatgctcatggataggaagaatcaatattgtgaaaatgctcatactgcccaaagtaatttatagagtcaatgctacccccatcaagctaccattgactttcttcacagaactggaaaaaactactttaaatttcatatggaacaaaaaaagagcccacatagccaagacaatcctaagcaaaaagaacaaagctggaggcatcatgctacctgacttcaagctatactacaaggttacagtaatcaaaacagcatggtactggtaccaaaacagatatatagaccaatggaacagaacagaggcctcagaagtaacaccacacatctacaaccatctgatctttgacaaacctgacaaatacaagcaatggggaaaggattccctatttaataaatggtgttcagaaaactggctagccataagcagaaagctgcaactggatcccttccttacaccttatacaaaaattaactcaagatggattaaagacttaaacataagacctaaaaccataaaaaccctagaagaaaacccaggcaataccattcaggacatgggcatgggcaaagacttcatgactaaaataccaaaagcaatggcaacaaaagccaaatagacaatgggatctaattaaactaaagagcttctgcacagcaaaaaaaattatcagcagaatgaacaggcagcctacagaatgggagaaaatttttgcaatctatccatctgacaaagggctaataacaaaaatctacaaagaacttaatttacaagaaaaaaacaaacaaccccatcaaaaagtgggcaaaggatatgaacagacacttctcaaaagaagacatttatgcagccaacaaacatatgaaaaaaaaaactcatcatcactggtcattagagaaatgcaaatcaaaaccatattgagataccatcttatgccagttagaatggtgatcattaaaaagtcaggaaacagatgctggagtggatgtggagaaataggaatgcttttacactgttggtgggagtgtaaattagttcaaccactgtggaagacactgtggcgattcctcaaggatctggaaccagaaataccatttgacgcagcaatcccatcactgggtatatacccagaggattataaatcattctactataaagactcatgcacacgtgtgtttattgaggcactgttcacaatagctaagacttggaaccaacccaaatgcccatcaatgatagactggataaagaaaatgtggcacatatacaccatggaatactatgcagccatagaaaaggatgagttcatgtcctttgcagggacatggatgaagctggaaaccatcattctcagcaaactaacacaagaacagaaaaccaaacaccgcatgttctcactcataagtgggagttgaacaatgagaacacatggacacagagaggggaacatcacacattggggcctgtcagggggtggggggctacgggagggatagcattaggagaaatacctaatgtagatgaagggttgatgggtgcagcaaaccaccatggcacgtgtatacctatgtaacaaacctgtatgttctgcacatgtatcccagaacttaaagtataataaaaaaaaaaagaagtaaagggtaacatatcctctctgaagattatatctgctttataattcaactaactcatagttatgaggtttattcaacatcaaaacatgaacaaattccaaaatgctgaaagtcaaatgagtttttattaacattctcattaagaaataaagatggcggttaggtttataacaggaataattcttgaaggctgaataacacaataattctcaaagacaggattttttaatcctctctcatcttccccatctcagtaaagagcacaactgtctaaccagctattgaagctaaaaatctaggagtcaaccttgattcctttctttgcataggtttaataaaataccattacttcatctaagtcccatatatatggaatatacataatggaatatgtgcatacacgcacacatatatagatggaataagaaattgtcactgaaaaccagtcttaaacttctcccttctccaaatacgcacccacacacccacatttatattctcatttatcctccccacaaccctatggttagtcattattctattccttctcccaacagtggccaagaattgctgcattgtggctcagggttgctgcctcatggcacaggaattttgattagggagtgggggaatgggcaggcagtgtattaggtaattttggaacacactgcatctttgggagagggcaggccataagtgagacagaggagtaactaaaactgcaagaaaacactgagttcctgcagagaggctctgggatgtggaagatgccacagaaagtaaagaagccaagtcctaaccacactttttttttttttaaagacagagtctcacttttttttttaagacagagtctcactttttttttttttttttttctcaagacagagtttcgctctttcacccaggctggaaggaagtgccgtaatctcggctcactgcaacctctgtctcccaggttcaagttattctcctgcctcaggctcccgagtagctggaattataggcgcctgccaccacgcccagctaattttattagagatgggttttcatcatgttggccaggctggtctcgaactcctgacctcaggtgatccacccgcctcagactcccaaagtgctgggattacaggtgtgagccacaggtgcccagccaaatctcactcttttgcccaggctggagtatagtggcacaatctcgacttactgcaacctctacttcctgggttcaggcgattctcctgcctcagcctcccgagtagctgggattacaggcacgcaccaccacgcctggctattttgtatttttagtagagacggggtttcgccatgttggccaggctggtctcgaactcctgacctcaagtgatccacctgcctcagcctcccaaagtgctgggattacaggtgtgagccactgcactgggcctaaccatacatttctaagttttgtttagagaagaccttggatccaggaaaggagagaaagctttatactatcctctgcttgatcccaggacccaggctagtggcagagttctagggtccatctgccttaaggaaaaattatctcttctgttttaatctaggaataaaatcacatttatccctatgcctggcacatagcagacaccgagtcaatgtttactgaatatatttctagaaagttccacactagccttacttctccctattgccctccactctcctgctgaactgattcaagtactccccacactagctgcctccgagcctatgctctgccctttcctcctctgaaaatgccttcctccctgccctctcagagccaagttcaaatgtcacttattccatcacgccctctctgatccctgccatcagcaaacatcctgattctgagaccatctcatctgttccacattacagcactttccccttctaacatctgtatcacatacatgacttctgtcttctgctagcatgagagcctgcttgaggggtgagacatgatggcttgcttttctagtctccagaccacatacagatttttggttatacaaatacaagctttactaacttcagaaataagccaaaagaaaacacaatgaggttgtgttgttttttttttctgactgtatatgtgtgtattgttctactaattagtatgatttaccaccctaattcatgcagtgactgtgatgactgtgcagtatctgattccagagtcttgggtctgaaaactaaggaacagtgatgcctgaatcctatcattggtcaaacacacaaagttatttttatcgcaatcaaacttacctcatttgctaaggcaaaagttccccagtgaattgccatagatttctttgtttggacatcagtgtgaatccttacagcttcttctgggtctacatgctggtatttcataaaccacctgaagaaacatggcaatttcttaattctgacctttgagatatacactaaattctaaaatctgtttcacttaaccaaactttaagattctgcgcaggactatggatgttgagaattaagaaccactgggataaaacatgcagttttggggaggatgagctagaaaccaagtctgaaggccaggtcaaggctagattgtaaaaacaaaacaaattctgcacaggaattaagtcacaggaggcaaaaccatctccctttggtacactttctgctgaaaaataaaacaagcaaaagtctttcttgtacaaattgctataaaataagtaagtctcaagcaaactcccctctgaatagtgagatttttgtttcacgtatattttgattttactggatctatctgaagatacaacttactgatgatgcaggggaggcgagccccaaaattgaggcttagcccaggagggtttttggcctcacaaacgaaatataattcaacggcaagccagtggtgctggccagcaattttttttaaacgatactgctccttgaggagcagtgctaagttataggcagtaagtgcactcagagttggcaacatatgaggggttggtaactgtatttacactcacttatacccacttttaattatatgtaaattagggaatgggttaatgcaaattaaagggcagattatttagaactttctaggaatggggtggtaacttcttggtcattgccatggaaaggggcagtaacttctaggttgttgccatggccatttataaactgtcatggtgatggtgggagagtcttaggctaatgagcaatgagggcagctagggatcacttctgtcaccatctgctggtttttgccagttttttctttttttctttttttttttttctgagattgagtctcactctgtcgcccaggctagagtgcagtgccgcgatcccagctcactgcaacctccgcctcctgggttcaagtgattcttctgcttcaacctcctgggtagctgggactataggcacgtaccacctctcccggctaattttttgtatttttagtagaaccagggtttcaccatgttagccaggatggtactgatctcctgaccttgtgatctgcctgcctccacatcccaaagtgctgggatcacagacgtgagccaccgcgcccagctgccagttttttcactttatcaattgagactgggaaataagtcctgcctcactgttacttttaaaagtagatattttacagtcctggatatgtatcaaagaaactgaataattggtaaagaaataaaaaccaaagctccaattacaaaagaatttgtatgtcctgctgatacaaatttgtaaaaacctgctaaagcaaaaataaacaaaaactagtacataaaatttaaagaccaggagccaaatatccaattactattcaagaaattttatttaatcataaaactgaacaatgaggtgtttggtttggcaagaagatcagactaatgggtaaatgattaaggaaataatgaaagggtgcctaatgccttgggaagagcgagggctcaggaggcagaaggcttgggtgtgaatcctagctcttgcagttcttagaatgcctttggaaagtctgttcaaattctctgagctgctatttctttgtctgtgaaatataaattttaccccattatgtgagggtattgtgaggattaaacaagacaaggcttaggaaagcatagagaacatcatctactttcatagaattctcccaaaacagtaaacaaaaccaacactttcagaagaaagacgtattattcctgatataaaggagaaagtgtactgtctacaagcaaatcctttgccttccaagccatcagtttcaaggaggaaaaacaacactgtattcacattatttacatcctagtctgccagtgacaactaacactacagtgaagaccaacagacatggattcagcacaggagcttccacactttacagaagacatcatggagaagtttatccatctgcaacagatatttactgttaggagttgctgggtcctacagaaggctgaaaacaaagccactgtgttctcctcaacagcaaatgagagcagcactgttctgccatatctcctgactcttgggattcagggaaagatgaaaatggtttttggtgtttctctcttgattttttttaaatcctagtgcaaatcaaagggatagatatattcctttccacctgaaatagatttaaattttttactgtgatataacaattaaaataaaaacttaaaatcttaactgacttggatagaatacctggtgacaggagattccctaaagtaagaatgaaacattccaagcatattattgaaagttgttttcggtctaaacatcttaaatttatagagcactctcaagtgttattcaatatcttatttctaaagccgttaacagtaaccaaagaaacagactacacattagaggctaccacaatttaactctcttagggcaaataatagcctccttgtctttttcccatcttagttgtttcctgtttgcctgcaatgcaagcaggaaagggggattatgtgagtaaatttggttgtacatattttatcatcacaaatatatgtgacaaatttatatattactacatatgaaaacttattttcataacaaataaaagatgttctaatctattaagaacatacatcaggctgggcatggtggctaacgcctataatcctaccacgttgggaggccgacacaggcagatcacttgaggtcaggagttcaaaaccagtctagccaacatggtgaaaccctgtctctactaaaaacacacataaaaaaactagccaggcatggtggcaggcgcctgtagtcccagctacttgggaggttgaggcaggagaatcacttgaacccagagacggaggttgcagtgagccgagatcgtgccactgcactccaacctgggcaacagagtgagactccatctcaaacaaccaaccaaaaaaggaacatacatcgagtaaagaccaattttatgttacaaatacataactgatttgtaacagttctaaaaatatataagttgacaggttttgagaggtttcattagaattataactatttaattagaaaagtaaaattcaagcaccaatattgatttgtaatcattttaataattatcaagaaccaaaaaagggtaaaaatatctagcccctccaaataaggaaactagcaaaaaacaaaaagggataaataagcattagtaaataaaaatagggacaaaatcgttttagtgaatgtaaaaatttagcaaataacaaaatcagatgaaaacaaaagtttagattcattcaattcatctatgtattagagaaatacttgttcttccacttatggaattacctaaacaaaatgttgttgtatgtatctgtccatgcactatagaatacaatatttttaaaattatccattgctttgttactattagtgttttgttttctctttatttgcacatataaaccagagttgactgaaatctaacttaattctttgaaatcacttctcttttccctaaacagagaatattaaggaaaacaaagacagtggatgagtctcctaggtgtccaatgagagtgtgacctttcgctgctctgaaataggtcaatagtatgtcaaggttggaggatgagtggtgagtagtacaacaccaccatgaccagattaacttcagtgctgactgaaataaaaccctcaccagggactaatgctataggccaattccttgctttttctctttgctaaacgtaggagagctgtaggacaggggattggggcactcaagttatggagcaaaaggtggttatataaagaaagtattctccatgtgaaagaataagagtaggttttattactggctgaccagtttagttgaatggtatgtgaacttctggctaggtatagtaattctttaaaccttgatccctttcttatggtaacatcatccctgattttgagtaatttttttaactcatatgactataattaaaatattttaattctcaccacaaaaacataagtatgtgagataatgcacatgtaaaatagtttgatttagttattccacaatgcatacatatatcaaaacatcatgttgcacaccatatacacaatttttacttgtcaatttaaaaaatatttaatttaaaatatttaaaaataaaatctaattgaatctgacctaccaacccccaatcatgtataacaaagtccaccattaaaatcataaattacagtgtcacaaaaatcataattgctttacttttaaattcagttaatttatcacatagcaggaatgttttctttggaagtctacatacctcggttcataagctccgatgggaatagctgcaaggtcaaaaggtccaaatctttttcctatctcttcaaaagcagggcaataaccagtatctcctgcgaaaaaaaatcgattccaaggccccaagacagaccagctgccccatagcaccttgttgtcatccattagagtccttttacaccagtgctgggaaggtgtaaagacaaaagtgaccttatcatgtccggggacacaattctcctcccaccagtccaactcaatcacattctcacagccacatttttgcatccagtcaaggagacccaaaggcacaaaccatctcaactcattaccaaatcgctcattcaaagcaatgacagaattgtagtccagatggtcatagtggttgtgactgataaggaccgcatctattggagggagttcacttattgtgcacggggaacgacgaaatcgctttggacccatgtactgcgatggtgaagcacgagagctaaagatgggatccgtgagaaatatgagctcatccatttccaccattaccgtggcatgtcccagccatgtgactcttaagccagcttccctcactccagcttcttcagggttagtgataaaatatggcttaagcactgggagttctttgtctagttcctttgtgtataaagaaagcaagacaaaagagtagttagaaaaaaaagtattatatcatcatagtccacattttgacctaaataatggcaagaagagctgttttaagagaactaaagtcattcaataaacttgctacacttttgcttttttcttgaaaatgcatacttctttctgaatctgacttaataatcatgataatatggtaatcttcttcctcccaaatgcaaaagagaaaattaaatttaaaactttgagtgctgctaaatgtatcaattttttaaaggctctcttcagtactgccagaagtagactggcctagatgcagtcatttttctattgccattctactcagctgatgtatttgctgctaaaaactgccttaaaagcaggtcagtccctggaaatagtaaagaaagcttatgaccatttatttgtagctcttggctctcagacatgaatcatgaatctgatatttttcttttttttttttttttttttttttttgtctgagacaggctctcgctctgttacccaggctggggtgcagtggcataatcacagctctctacagccacaaccccccagggtcaagtgatcatcccacctcaacctctcagctgggatcacaggcacacagcaccaccatatccagctaattttttattttttgtagagacagggtctcattatgttgcccagattgatcttgaactcctgggctcaagcaatcatcctgtcttgccctcccaaagtgctggtattataggcgtgagccactgtgcctggcctgaatctcactttctgagtacctataattcaaaatggagcgctgtgatgattcctggacaaatcacagtcataaattgttttcctcattccttacctttctgattttctaccattaatcaaaccaacgtgaatatgatcccttcctgtgagaagctgatcactgagataaggggggccgtaaatggatataaaacaataactataacaaagcgtgaagagtattatcccttggttattctacattttatacttggattaagctaggccaacaaaaagtggtaaggttgcagcatcacagtcctggcttttataaagctcttttactgaattgtgctctggtaccatgctatatagctgcatggaggtctctcataggaagccacctcatgaaactcaccatgtatgtgttcaggctgcagacttggtaccacctccaccttcctacttaccccagaaacatttccctcccatctcgtttcaggaaaaattcttctccagagcacctggctttgtcatttctgtcactgggaaaactcttaagatttcatgatacttctctctttaggaagttcagaggaaaagctgaggccacctgcagcaacgtgcagcacatgatggaacatatttctatattaactttattcttggctttattttatttttctagtctaatagtccattttgctcctagactggctaggtatagtaattctatacctcatccaattctttttttactgctttatgtatgtttgtaagttgccactaaatcaactttgaaagggtgtggtactggataagtagttaaaatacaggtcatgttatagcctgataagaaggaatgaagagcccagttgccaaaggcatcacagacacagtgacttgtgtgagttcctgaagaatgatgagaaactcatgatgcagagaaaaggaagaagggcatttcaagtagagaaaccacccaagcaaaggtacagagccaaacaggaatgtggtgtttgagggcaggggacaaactaaatctataaagatgggaacacattaagagccttgagtgtcatgcttcactctaagacaatgaggaagcatctttttttttttttttgtagagacagggtgggttttaccatgttgcccaagctggcgtcgaactcctgggctgaagcgatctgcttcccaaagtgctaggattacaggtgtgagccaccacgccaggcctaggaggtatctttttgccctcacacgtgcacacacacacgtacacatgcatgcatgtgcacacacacatacacacagacatgacccaattatgtttagataaaacaattctagagtccaaatgatggcatggagagtgtcacaacagttgccaagatatgaagagatgaggacctgagcaaaggatacaccggtagacacagacaaaagagggcagatggggagatgctggtgaagggaaactgagaggtcaatgagagagtgagtctgaatgggaagaaggcctggacaggaagagaaggagcagcacaggtggaggacaaaaaggtttctcttagccacttaaacctttagtttcctcatctggaaaacaggtgtaataattgtacctatgcttcattcctgtgaggatagaattacgagtggctgggacataataagcactctacaagtagtccaaaagaaaaagcaagaaagttccaaccctgacaacaaaccaggcaccaatgttaccaatcttttgcatttccgtggagctactaacctagttaagatgctaagaaatattcagacattcaaagctctccagattgctcaactatctgcctgtcaactcaatccatgcacaagagccacctcaaaaacagccaacttaaggtataacttaagtctcctctgctgcaaaatctccactggctctctactgcctgacaaagtctgtctcacctcctcagcccagcagtgagctgcccagggactgccccaattctctcgggcgtttcatgctcctcttccacatgtgctgtgtcccacctacatggagactgcttcctactcctagactgagctcaagaaccctgcacggtactcatcccatttctcaggttaaattatcttcccccttatcccttcgggccatctcttgagtcccacagctagaagcacttactcctgcctctcaacttccatatctccctattcacacatctcctctggatattctggttatgtgtacacagaatttgtcccatgtcttatgaaaggtggaatcattcagtgctcagtttgattaatgaaacacagcatgtgctcaacaaaatttgttgaatggatgagtaaatgaatgaatgtcaactttcaatcagttcttaaatttgggagttagggttagtgaacaatgacatatgccaagaggtatacttatccagaattaatgaggaaagggagagggaatgaatataaactgagtacctactaagtactcgtacttggcatcatattgggcacataatgatgatgaactacctaatgtatcaagtactttagcataacacaaaacaaaatactattaacaacagctaccatttatgaagtgcttattatgtgctagacactgtactaactgctactggctacgaccacaacactggaagtaggtcctataaaccagctccattctacagctaagaatacaatgaattagggaagttacagcactcaggcaaggtcacccagccagacccactgtagtaaaccatacttcctctcattaaatctcatttactaacatgttttcgtaaaaagtaacagcctggggtccaggttgggagaataagggggtatgaatttcaaaaggacacaaggaaacttttggggataatatatatgttcattgtcttgattgtggtgatcttttcgtgggtatatacatatgtcaaaactcattaaattatgcattttaaatatgtgaagcctatatcatgttaataaaactatttttaaaagtttaaggctggtgctgtggtacatgcctgtaatcccaacacttcaggaggcctaggctagaagactgcttgaggccagtagtttgagaccagcagggcaacatagtgagatcctgtctctatttaaaaataataataaataataattaaaaaataataatagaccaggcacagtggctcacgcctgtaatcccagcactttgggaggccaaggtgggtggatcacctgaggtcaggagtttgagaccagcctgaccaacatggagaaaccctgtctctactaaaaatacaaaattagccaagtgtggtagtgcatgcctgtaatcccagctactcgggaggctgaggcaggagaaccgcttgaacccaggaggcgaaggttgcagtgagccaagattgcaccactgcactccagcctgggcaacaagagcaaaactccgtcttagaaaaaaaaaaggaagaaagaaagaaaaagcatatagaaaaaggggtggggagaggatggactcttgtttacttgaggaaactaatcactcacgtggcattttcatggctagatcaagactttcttggctggtcttcctttttgaaagctgcaaaatggaaaatcccaagactcataattaaccagtacgctagttaatgttttacttttctcgggaaaagggaaaaatcctaacgttcattcaatagctactctttgcaaggtgctttaggtatactgtgtcatctaaatttgtgaagcaaatattactgccattttacagatgaccagaccaaggcagactggggtcactaagaaatttgccaaagtcatgcaagaggtaagtacccaatcaggagtgaaatctaggtcttcctaactcaaaagacctctctttcactaagccatgctccttcgatggcataaatattaacttacattaaaattaaacaatgaaactcatatcttcttaacatacttacaattttaagagtatgtgtttgtgtgtattaatgagacaaaaaagaaagatgtgactcaaatccatttaaaccatgtttttaaaatatcacttttaaagaagacacagtaatacttttcttccaactgaaggtacattttcaccatcttagaaaactttactacctatactgtaatctgcaactcagattttttaaattaaaaaataacatttttctttttcacatttgttatatgtgaacactgaataaagatacatgtgttaccaaaataactccaattcaattaattattgatgccaatgtttgatatttttgccatgtgtattaagagtataagatctatcaaaatggcttagtatttttaaactccttgattataagagaaaatgctcttaatatgtggaaaatgcagaaaaatataaatagttgccatcattatatcaacatgcagatattataaccactgttaacattatgatctgtacttgtagttctattttatgaatggttgcaatcagagtattcatattttctagttttataaaaaaattgtatatggtgacattttcagtcatccctacgactctacgagacacaaggtttaaaaatgaaacaaatagggccaggcacagtggctcatgcctgtaatcccagcactttgggaagccggggcgggtggatcacctgaggtcagcagttcaagaccagcctggccaaacatggtgaaaccccatctctactaaaaatacaaaaaaaattagccaggcgtggtggcaggcgcccatggtcccagctactcacaaggctgaggcagaagaatcacttgaacccgggaggcagaggttgcagtgagccaagatggcgccagtgcactccagcctgggcaaaaagagtgagactctgtctcaaaaataataataataataataataataataataaataaaaatgaaacaaattcttgaggaaatttttcagaatgcaaatttttttcaaattgctgaaatttattaaaattgaaagacattgtttaattaatcttctctgccatgaaactccatcaggctgtgtacaaaaaccactgggaggctgagggtcactagagcccgggagtttgaggctgtagtgagcctcaaagggctactacactccagcttgggtgacagagtgagaccctatcaaggtttgcatgcttgcttgctatctgtggtcattaaaaaccctagacctctttaggaaatcaggtctgcctgcacttctccaagcatgaattttgagttctttgcttctttaaaacttgctccatgtgcactgttgtcaagccgattctctatacctttaa

SEQ ID NO: 702 - DNA, 24420 bp, Homo sapiens
atggtccaatgaccctgctacaacaactagaaaaaaacagacacattacaaaaatcacatttaaaaaagatattggcgagccatggaattccaggggaaggaaatttttctgaagtgagctgacaatgcacagctgctttttttccctgggaacgtgtgccagctctgggtaggaaagaggacagggctgggcccaggcagagaaagtctacaaatgggaagagaaaccaataggcttatggtggtggcacgggggtaacatgacaggttagaaacttgaggtgccccaagtgtggccactgtctcccataaggcagtgagttctgggagtgttcacacaggaggctgaggagctagaacatcaactcctacaaggcagagtgagtctttcataatctcagggaaggaagaggaagcctgcctcaaacatacagccagcataaccttcaatgtacttgccagattttaaagttgagggcccacggccaccacgccatctgggaagtaaggagcacctctgcccagccgccccaccatctgggaagtgaggagcgcctctgcccggccgccccaccgtctgggaagtgaggagcacctctgcccggccgccccaccacctgggaagtgaggagcacctctgcctggctgtcgccccctctgggaagtgaggaggccctctgccctgccgccccactgtctgggaagtaaggcgcacctctccctggctgccccacagtctgggaagagaggagcgcctctgcccagccgctgcaccttctgggaagtgaggagcgcctctacctggttgccgccccatctggaaagtgaggagcgcctttgcccggccgttgtgcaaccctcgaagtgtgaagtggcagccttgtgtgtgatttttatgccctccccaagtttgcatttttgatattaaagtttacttttaaaagttttaaattggggaatatatatacatatataaaagttgagggcctagaagggaaactaaagagctaagcttaaatacctccgaagagcagaaccaaatctctcacaatctttcagtctgaggagacagagactggctagcttctcaatcaaaagcccagaagagctatgcctgaggaatagggatgaaccagatgtaaaccgaacccaaataaatccacagtccaagctcaacacagatcagtcccttcctggactgaggtcatgagctctgtaccctatacagaggaaaggacgaacctttgctggcgaaagagtatatcatctggaacttctattgttcttttctcacacaatgtccaataaaaataagaaattactaggtatgggctgggcgcggtggcccacgcctgtaatcccagcactttgggaggccgaggcaggtggatcatgaggtcaggagatcgagaccatcctggctaacacggtgaaaccccgtctctactaaaaatacaaaaaaattagccgggcatggtggcaggcgcctgtagtcccagctactcgggaggctgaggcaggagaatggcgtgaagccaggaggcggagcttgcagtgagccgagatcccgccactgcactccagcctgggcgacagtgcaagactctgtctcaaaaaaaaaaaaaaaaaagaaattactaggtatgtatgaaggcaggaaaatgtcttgaattatcaacagaagaaaataagcaatagaagcagacccacaaatgatctggatattcaagttaacaaacaatgatttaattttatgtatttattttatttatttatttttttagagacacagtctcactccatcacccaggctggagtgtaatggtgtgatctcagctcactgcaacctctgcctcctgggttcaagcgattctcatgcctcagcctcccaaatagctggaattacaggcgtgcaccacacctggcaaatttttgtatttttagtagagacagggtttcagctggtctcgaactcctggcctcaagtgatccacccacctcggcctcccaaagtgctagaattacaggcataagcaacaaacaataattttaaaataacaaccatcaacatgtgtgttgatccattttgcacggctataaagaaatacctgaggccaggtaatttataaagaaaagagttgtatgcggctcagggttctgcagggtgtacaagaagcatggtgccagcatctgctcggcttctggcgaaggcctcaggaagcttttactcactgcagaaggcaaagggagccagcatgtaacatgggaagagaaggagtaagagaaacagctagagggaggctcttctaaacaaccagctcttgggtgaactaatagagggagaactcactaattatcacaggggagggcacaaagccattcttgagggatctgcccacatgactcaaatacctcccactgggccccacctccaacactggggatcaaattttaacagatttggagagaacaaataaagaaaacagaaaaaggcaaactgaatgaaaagatgcataattctaataatcagaatttatttaaacatcaaattgtcattctagaactgaaaaacatgtctaaaattaagatttcatttgatgtatttaagagtagactggacacagcataaaacaaaattagtaaacttgaaaaccatcaatgaaaaagatccaaacttgagctcaaaaagaagaaaatggggaaaaagcagaagagatcaaaagaggcatgtagaacaaggtaaagaaaaagaaaaaaaaagctaacatatgtacgattggagttccaaaaggaaaagagagaactgaatagaagtactatttgaaaagaaccaagaattttctaaaacggatgaaaaatatctatcaacagattcagtaagcccaggggaccaagcaggattgtttaaaatgttttttaattttttatttttttagagatagggtcttgctccatcacccaggctggagttcagtggtgcaatcatagttcactgcagcctcaaattcctgggctcaagtgatcctctcctctcagcctcatgagtagcagggactacaggtgtgagccactaagacaagttagcttttttttttttttttttttaatttttgtacacacagggtctcactatgttaccgaggctggtcttgaactcctggcaagcaatccacctgccttgggctctcacagtgctgggattacaggcatgaaccaccaagccaggcctgatttttaaaaaaatcagtctctattcaagagatttgcaggaaaatgatattgtaggtagaaaatcaggttttatttaggacaggtagatgaaattcagaagaggttaaatatacagggaaaactttaatgaaaggttatttatgtattccaaggcttgcagaagatgggttttagaaaagtataaaacctgccagacatggtgggtcatgctgtggtgggtcatgcctgtaatctcagcactttgggaggctgaggcgggtggatcacctgaggttaggagttcgagaccggcctgaccaacatggtgaaaccctgtctcgactaaaaatacaaaaattagctgagcatggtggcaggtgcctgtagtcccagctatttgggaggctgaggcaggagaatcgcttgaacccaggaggcggatgttgcagtgagctgagatggcaccactgcactctagactgggcgacagagctagactctgtctcaaaaaaaaaaaaagtataaaacccatctgggaaattgagtcagataaataaatgtacagacaggatatgaggcagaatggaattcatcttgatattctcttagaagaaatgggtaatgagtttaaggtgggtgtgtggggcccagaggattgctcctttgcacttcctgctagtgtgctagcagaggtgagtgaaggactcctcaggagaacatgatcttagacaatggagaatgcatataagggcctcctctatgggtgcagaacaatgcagtaagctggtaaggaaggaatgctttcacccagagggggaactggggactgcctcattgcagctttgtgatgttatagtaactggcggcctagatgagaagaggccatcccttccttgatgtaccctgactctcaactcaagtccatttctgccacctgctccaccgccatatcacagactgagccatcactcagaatggctgcaccctgaattgtaaatataaacgttccactttctgacccccacctcctgtgtttccagctccctcacttaattactccctctacttctcttcactcacctcttagaggagtcttcactttctgtccatgtatcagtatgatatccttttctcatttcccactgagtccttagagtccttggcccatcacttcagatactcaggagcttagctccctaacctactgcctttccattctattaatatatgcctggcaaattcctatcccagacgaagtcaacttggttatctctgtacctacatctgatttactgactgctacttgagaaaatcacacaaccgggaagatgggtaccattctccctacatattttcaagcacaattgtatagaggtacaacacaaaactcactgtaataaattaaaacaatacagctatggacagagtaaaaagttagaattctccatcttttcccccaaaaccattccacaagacatctgttattaacagtttggcataggttctatgcatgcactattgtcttaaagctagatatatacacatatatgtacataaacacatatacaacatatatgaaatcaaatggacagctagagcagaatggacagttgctaagcaacttgcactttttcttttttacttaataatatgtgttgggagccagccatgtggtgtatgcctgtagtcctagctacttgggaggatgaggtgggaggatcaattgagcccaggagtttgaggctgcagtgagctaggatggagccactacaccctagcctgggtggcagaccaacaccccgtgtctcaataataatgatgataataataatatgtcttggaggacatttcttcttagtaggtacagatatactttattctacataatgcctcattcgcttagtcactctaggtcatttactatttttactatgaaacaaagttataatgaatatccttgtacatcctcctgaacacatgtgcaagtatttctctaaagtagatccctagaagtagaaatgcttggttaaagggtacatgtatttaacatcttaataaatatttctcaattaccatccaaaaaagagacgggtggggggtctctaccaaattgccctcccaaccgcctaggagcgttactaccctcaggtaggacctcctctttctttccctagacatctctctccctcattctccacataacgtatctttgctcgaacctcctactgcaccaacatccccatccccactcaaacacgcacattcttggtaaatatctcaccaactatttgtagagaaaaaaagaggtcaacaaaggcaaatgttctcagcttcctacccccaaacctacaaaacctaatgtctatccccttcctgtcttccttccctactcttataacggcagtaggagggcagtccttcctgttgtctaaaggcaatcctggttgagagggtccttaccttcacaaagggctgactacactgaccaaaggtctcagcttccactcttccctccgctaacctccatctattttctgccctcacggctccatggaaacctcaggctcaccttgggcagaatccagctccttatcttaggtgactagtgcctactccctacttctgacaacattcttcataatgccagtctgctgattttcctcctcaggctctctggcacttctttctcactcctccactcctcaggtacttcttgtccaaaccttaaaatctgagtttggggtttccgatctgggccttgtgctcattccccctgggagatgtcacccattccccacgtgcagccaccatcaccctctgttttctctctaatcagcgtcttcagccctgatcgcctacaagtccgaatttgacttcactttctcgcattctgccccgccttccctccactcctccccaatcccgaaacctagtccctcctccgggaagtctttcctgactcctcccccttctaactccccaccgacggtctgtgtccgctgccacgcgtgtccagtacctcgcagacctgaggaatgtagttctccttgaagtagttcttcagcctcgggttggcattgcgtagcgaggccatggcccaaggcctgacggagaagctgcgatagtaccctccccgcgctgggactaggggccgggcgcgtgcgggcgttgtcccggcaaccagggggcggggctgggcgtggcaccgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgggaccccggggtttccggcaggtgggcggggactgggcaggggggctccccaggccggggtggtggcttgcgtgtgctcggggtaaaatgaggagccgagctagagggagaggcagtacttgtgtgagtgcagggtgctgcgccgcccccgccgcccctttgctgactatactggtatgaaaacttgccctggctttcctgcctgagctccgcgtcacagcggaggattagatttcttaaaaacctgttgatggcctctcattttaaagcttgctccgggcctttgtgtaactaaagggattctcccgattgtggaagggctgttgaggggcccagagccataggtcaatctctgcttgcaggtgccctggaagaagggacgtcagagggtcagttgtgcgggcgctcggcccggcctcagacgggaggtacctgggagtcacagtggtccaagacctcgcagcctggtgtgtgttttggaaatgggaacagttgtctgcgcgagacacaccctcccagcggacaaatgcatgattcggtttctgtccaaaagttgatcggtacattaaaaccctccaaaggcatgtttcacatcatggaagctgttagggaaataatttaaaatatcatatctgccatccaagaaactcctgtccacaattgtagaagagagctaaacagcttcattgttgaataagcacaaactaaattgcctcacacatcacgggcaatttgctaatgggatagcaggaagaattctaattcctttaaatgtagctggacagatagaaccgatttcatattacatacgtgttctcaagataaaaaataatttgtccttaggtaagaggacttgacagtaccatttgctacatgtagtttatcctgaatttactggtaattggggtggttgttatctaattgcctttatccagaggaaaaataaaaatatctttatgatgtggaaccaggtgcccaggctaaaaactcacagagttggggagattggggatctatcttcctggaagagtaggtttcaaagagtacgctttcgaacagtaggctccaaagcttttaagaaagtctttcttgggctgtaaaactggccaaatgcttatttcacttttaaaaagatttacaggctgggtgtggtggctcacacctgtaatcccagcactctgggaggccaaggcaggcggatcatgtggtcaggagttcaagaccagcttgaccaacatggggaagccccatctctactaaaaatacaaaaattagccgggcttggcggtgggtgcctgtaatcccagctactcaggaggctgaggcaggagaatcacttgaacccaggaggcagaggttgcagtgtgccaagattgcaccattgcactccagcttgtgcgacagagcaagattctgtctcaaaaaacaaaaaacaaacaaaaagatttacatttgtatcaaagaagcagaaaaaggagttttgttttgttttcagacagggactccctctgtcacccaggctcggtgcagtggcgcaatcacagctgcagcggcgcaatcacagctgcagcctccacttccctgggctcctcccacctcaccccactaagtaactaggactacaggtgcacaccgacacctggctaatttttccaattttttaggagatgagttttcaccatgttgcccaggctgatttgaacttggcttaagcagtgctcctgcctcagcatcccgaagtgctggaattacaggattgagcctcctcacctggccaataaaggatttttaattacaagtttgcacgagggaatgctttaagaaaaagggagtggaaggggaaggtctctctcacttttgccactaggtataattcagctttttttttttaaagatttgtatgtacccttactgtattagtccattttctgttgcttataatagaatatctgaaactgggtaatttattaggaaagaaatttatttcttagagttatggaagctgagaagtccaagattgaggggccgtagctggtaagggctttcttgttgtggcatagggcatcccaaggccagaggggcaagtgtgttaacatgctgactcaggtctcttgttcttataaagccaccagtcctgctcattaatccatgaatggattaattcattcatgaggacagacccctcatgatccagtcacctcttaaaggccttacctctcaatactgccacattgggaattaagtttcgacatgagtttcgcaggagacattcaaatcatagcatttacaaagcctaatttgttgtctttgcccatgtcagagatatttttgtataagtacattgggaaggtgtcctggactcagatatcttctcagttatactgactcaatctgatgaatgtggacagtcttttaaacttaacagttcccataatcatcattatcttaggtaaggcagcttaaaaaataatttgctcacagtcccttcttcctgaagctactcctttatcattgaagaagacttgagaaatgctcatttcatcatcaatatggtttggctttgtgtccccacccaaatctcatctttttctttttttttgagacggagtcgcactctgtctcccaggctggagtgcagtggcatgatctcagctcactgcaaccgccacctcatgggttcaagcgattctcttgcctcggcctccggagtagctgagatgacaggtacacaccatgtgcctggcgaattttttttgtatttttagtagagacagggtttcaccatgttggccaggtgatgtgcctgccttagcctcccaaagtgctggaattacaggcatcagccactgtgcccggcccaaatgttatcttgaattgtaatcccataatccctacatcgtgggagggacccggtggaaggtaattgaatcacgggggcagttcccctcccctccatgctcttctcgtgatagttctcaggagatctgatggttttattaggggcttccccctttgctctgcactccttctctttcctgctgcctatgaagaaggaagtgtttgcttccccttccaccatgattgtaagtttcctgaggcctccccagccatgtggaactgtgaatcaattaaacctctttcctttataaattacccagtctcgggcagttcttcatagcagcatgagaatggactaataaagtcatcatcacgcttagatttcagaagatgatcttttgttttttgtttgttttgtttttgtttttttttgagacggagtcttgctctgttgcccaggctggagtgcagtggcgatcttttctttgttttaaactcacacctctaatccctttgggaggctgaggtggaagaatcgcttgagcccagagttcaaaaccaggctgggcaacatagtgaaaccccatctctacaaaaaatagaaaaattagccaggcatggtagtgtgcacttgtagtcccagctactcaggaggctgttttgggagaaacccttgagcccaggaggtcaaggctgcagtaagctgtgattgtgccgctgctctccagcctggacaaaagagcaagactctgtcttaaaaaataaaaaataaaataatttttgtactaacgtggtttgagagcattgaaaaagacggaaacagtcccaattcatccaacaatctaacgtcataacctgacaaggatggtaagaaaaactataaatctgtctcaactatgaataaagatataaaaatcttaaaatattagcaagtcaaatctatcaggggattaaagtaataatataccaaggccaaatggacatggaaggaggagtcatactagaaaaaggaaaagccacatgatgacctcataataaaaaggcattaaaatatttctttccatagctgaagctcggggaaaaaaaaagaaaaaaaattttatcatttctgataaaaacttgcagcaagtaaggaataaatagaaggaaatgttcttaagttgatcaagtacatccatcaaaacccaaaagcaaatatcgtatttaatagacacactagttagtagcatccttatcaaactcaagaacaagagaagggtgtctgctatcacagctactattcaacgttcttctggagtcatagcttgataagaaaacaacatgcataaatattggaggcagaattataatcgtaggtggcataatgatttacttggaaaaatccaagagaattaactaactactagaagcaatgagtttaataaaatatcttgagtacaagtaaatatacccaaatcaataacttcttgtatacatgcagtaacaattcaaaattttaattgaaaatattttatttgacagaatgagaccctgtttcaaaaaatatatatcattcatgatagctataaaaactttaaaaattaggaattcactttaaaaactaggagttcctgtagtgagaagataattttactgaagggcctaagactacataaacaggcatattgtgttcccagttggaaagattctgaaccatgacagttatcttgaaatttgtcttgctacgttataatgtggtagtcacttttcattccctttgagaattctaatttctccttgatttactggaggagaccacaaaccaccgagcctaagattctttcacagtcttgttggcacagagctagatggaaagtagaacacatgtttgactcctcacctgtgtaatagcagtccaaaaactcaccagtggaagagctgagtatttgatgatcgccctcctgtaaaatttttagagttttaagttttacatttctttactaaaaagttatacatggtttttgttttgttttgttgttttgagatggagtgttgctctgtcgcccaggctggagtgctgtggtgcgatctcagctcactgcaacctctgcctcccaggttcaagtgatgcttctacctcggccacccgagtagctgggactacaggcatgtgccaccactgctggctaatttttgtacttttagtagagacggggtttcaccatcttggccaggctggtctcgaactcctgacctcagcttatctgcctgccttggcctcccaaagtggtgggattacaggtgtgagccaccgtgctgggccgataaatggtttttattagaaattcaaagagaatatatagaattaaagtataggctcattattttattttttatttattcatttattttttgagatggagtcttgctctgttgcccaggctggagtgcagtggtgggatctcggctcactgcaacctctgccgcccaggttcaagcaattcttctacctcagcctccggagtagctgagattacaggcatgtgccaccatgcctggctaatttttgtatttttagtagagacagggtttcagcatcttggccaagctggtcttgcactcctaacctcgtgatccgcccatctcagcctcccagagtgctgggattacaggtgtgagccaccgcattcagctaggctcattatattaatatactaggaggaataatggttgagaggaaagagtaatgtaggagtaaaaagatctggattctaaagccacttttgctattattaatcagctatgtgtcccattaatgaaaataatatactagtcactttaaatattctaggtacaaaagtgctttgaggtaggcactattaactcccacttagcagatgagtaaactgaggctgagagagcctaagtctcttacctggtaagtagcttatttgggaatttgaactagacaacctgaccccatagccttggcttagttttaactaccacattgtgcctcttcccaccaagtgagaattctgtgatacaacaccgtgaaattttatcgttagtgatttaatccctagaaaaattttaaatggctatttataaagaatttatacatctataagctttctcttttttaaaaacaaaaacaaaaacaaggtttcattactgtcacgcaagctggagtgcagtgatgcaatctcagcttactgcaacctctgcctcccaggctcaagcaattttcccgcctcggcctcccgagtacctgggattacaaggcatcctgcaccacgcctggctaatttttttctgtttttagtagagatggggtttcaccatgttggccaggctggtctcagactcctcagttcaagtgatctgcccgcctcagcctcccaaagtgctgggttcacaggcgtgagccactgcacccagtctataagctttttaaaaatgacttcatgagataacatagagtggtatgattttgaaatatctcaaatatggatgagttaaatttatcacatttctgccatgcatgtgcacgtgtatgtatgcatgtgtatatgaaatcatacaacttcagggctgtgtaggaaactctggagccagttacagtattaagccaacccttttatttgcagatgagaaaactgagacccccaaaaatagtaagtgacttacttgtaactttgatttttcatttctgtggtttctgctactaactacccctgtgactttaggcagatccttgaacaatcctggcttcagtttcttcctgtgtaaaataagaggtttggatgaaccccaaattctttccgttctaaaaagttgtgtttttatcattctttcctttatcttttcaagtattctttgggtgaaacgctattttataaggtgttaatgaggccaacagtgtattcaaaagtaaaaggtcctgattaagacttggtagtgagaatattctagctttgtagctgtgacattttcttaacatttcttatttggcttcctcagggcatcacatattatatatcacgtaccacatattgtttcccatgtgtaatctatacttgtccctttatttatttttgtgtgtgtgtgtgtgattcttctttgagcaatatacttagttattttagttacagaaataatacctgtttattgcaaaaaaaaaaaaaagtactgttgagtacagggtagaaaataaaagtccttcataatcccactacccaaaaataatcacctttaacaattttatttacttattttttttttaatagagacagggtctcattatgttgtgcagactggtctcgaaccactggcctgaagtgattctcctgcctcccaaagtgctgggactacagagatgagctgctatgcccagcctaacaattttatgtgttttaagaaaaaacacagatttgagatcatgtaacacctattgttgtgtaacctcctcctcacctacccttgcccctccccccaccaccccagtaagagtgttataaaatggcttctgttcttcctgtggtgatttctgtaaagaggattttttttaaggtaaagccataagtttaaacatcattgagcagatccagcatttggctatcctagctcttcttcaaaatgtcaggttttcttttgtcatcaccaccagcaggactattattctaggatcctagtcatcatgccttgtataaatcaaacaaaaatgccacactagcaacaagattggtttactctcatagctttccttctatctgatgtgctcagaaaagatctgcttaatgcaaatcatatttcctaattaatctctttataggtaagtgttcattggatgggtgtacctcgtttttaaaaggagaagcaaaatgttatcagcatttgaggtatatagtatttgcatgaagtgtcttactaacagccatatgccaggtgaccattgactaatttcttggtatctataagcctacacttcccagctgtaatttgagagtactacaagtatcttcttcctaaggatgtaaagtgcttaatactgtgcctgccatacaagtatgtattcgatattgttttaaaaattttaaaaaaacaggctgggcacagtggctcatactattatcccaccactttgggaggccaaggcaggaggactgcttgaggttagaagtttgagaccagcctgggcaacatagtgagacccccatctgtacaaaaaatgtttaaaattagccgggtgtggtgcatgtgctaggaccacaggtcctacctacttgggaggctgaggcaggaagatcacttgagcccaggagatcaaggttgtagtgagccatgattgtgccaccgcacaccagcctgggtgacagagtgagagcctgtttcaaaaataacctcgtattgattttagcttaacttcaaataactttcttcttatgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagtaagtacctcaactcagcaagcaagctctttccattcttacacactagcggtaattgtgaccctgaataaattacttaacctctcagaccctcaatttcctcatctgtgcaatgtggctacttatacttaaaacataatgtttgtttacttctgaaaaacacagcctaatagtgatatgattattaatgtgattatagatccctatgaagttggtcactggcatcacattcgtaagtatatctaatcaacgtttaccatttcatggccttttaaattatttaaaattcagcagtgcttcagtaaaacaatgaatgcatctaacatttaagtacatactttaaattgtatatcggtcttatgaatatgattctgatgctgatggtccctggaccacactctgataaccactaatcaatgtaaatggctcctgcaaatggagacttaacactaagactaaagagcttaatttgaacatgtgcttcttcctactcttcctcacaaccctccagcatgaaaaaatagttaaaacaaaatttcgtaattgttttcagccaatgccctttgttaacattgtcataagtacaaaattattttgaatttatagttttttttagcccagctttctccagaatggcaaggtttactgtaaagctctataaacgtatagggagatagagaatctttgtgcattatgtactctttcagttataaatgacagaattcactttaaattattttaagcctaaaagggaaaatattgagctcagctaacttggacagcgaagaatagcattgatttcaggcacaactgagtccagttcaaggttgcagagttcccagagttctctctttctctaccttttggctttgcttatggccgctcaattttatgtattggtctttatctttctggccacaaagtggttttcttcaccagggttgaaagaaagccactagcctctctaagccttcatctctgtagctcattatccaaaaggtacagttgttcttctaggatccagtgttaaccctttggatcaatctccggggcaatttctggatcagtcgagggaccatggcccatgtttattgaggcctggttcacatgagcatcctgcagctaagtagcagggatggctgtgaatacaagtgaacaacaatcccagcagggaccgtgtgggacagaggagatgccacatctgcccccgtggaaagagagccactagacaagcaaaaacaatagctagtgattaatgtgttagcctgcctttaaagaagtatttctgatggcataattttgtattcctctaaaataagttgtagtcagagtaggccagtacccactggagaagaagtactttcttgagcagcgggggtcagtgccctcaccatcaattatagtaccttaatctgctttaacaatacagttaaaaaaaaaaaaaacttttctagtaactgcaagtccttcgaaagaacttgaaattgtaaagggaaagtttatttctcttttaatgctaagatcacccttaacggtaaaatggagtattgagctatttctaagaagtagattttggcagtctttttcttttttcctgctagaatagcatgtcttcacttgacaagaataatttttagcatatttttcttacgagaattaaagcgatttaattctttcaatgtttgagccaaaagcacatggtaacatagtattgcaaccaactgtaagacatcccagattattttccctctgaatatttgggtaccatttctcttcttttttttttttttttttttcttttttttgtggcagagtctcactctgttgcacgggctggagtgcagtggtgcagtctcaactcactgtaacctcctcccaggttcaagcgattctcctgccttaacctccccagtagctgggattacaggcactggccaccacgcctggctaatttttgtatttttagtagagatggggtttcaccatgttggccaggctggtctctacctcctcacctcaagtgttccactcatctcggcctcccaaagtgctgggattacaggtgtgagccactgcgcctggccctgggtaccatttttcaaactgtgtggaacctgattctgcaagatatcagtgcgttcccaccacttccactgctgaaaaaatgaccctttttttgtgtttagttcatagacatactatcgtcaacacacccctcttcaagattcccaatgcacatggacatattaaagaaacatgcttactcttgttatactcagattttcctaaacttagataaccatgggaaaccacccccccttatttttatggaacatctcttaacattttgagggattagtgtttcaaataatacgtgttagcaaaacactactttagtattctaaatccaaaacactaactttagtattctaaattataacacttttccagttttgcctataatggagaagtcatataactcatctcaaagaaaaataattttatttgtaagttgcttcaagatcgttatagtatctctataaatttttattgtatttctcaacattgtagtttaaataattatatatcttaataatcttattttcaatggattttctttacctataaaagtatgggtagtgagatttttttaaaatatgaattaaatatttgtatatgggaaagagatttccaaaaagccgttgatttttaattgtatttgtggatgcaaagaattcagtgaacggagatgcatactgaagtcccagtcctgctttttttttttttttcccctcgtaggctattattcgtgaattgggtggtattccaattgttgcaaacaaaatcaaccattccaaccagagtattaaagagaaagctttaaatgcactaaataacctgagtgtgaatgttgaaaatcaaatcaagataaaggtaagttgactgaaaatcacaaatgtataaggttttctataaataaaaaataacaaaaagatgagtaatgaaactttagtagactatcctttgtaattttacagccaaggattacctttagaggaatggagaataagacagaagagggagggacctgaactagccaataagaggtacaataagacttttgtttcagtaaaataatgcttgtttattctacaggttatcctctacatcagggacaggcactggtgacagtaatagccttaaggctataggcaccaaccaaatagtgaatatagttggctgaaagttgggacaagactttgcgctagaactagaactagtattacaagagattcattcagggagcatatccgatgctacatattcataaatatggttgttaatgcatacagtttggctagttttgcctttgaaattaagtgtactgtatgagtgtattgcaaagtgttaagtcactgtatgctttagctctttcaatggatgaggcaaatgtgcaaatagattaaactgacttttacagaataactgttcctttatcttgttgtatggggagaaatcctccattttaggatgcacataaaatgctaacctacgttactgacattgctttaatgctttttcaaaaatgttatttatgaggcagttaacctgtaaaaaaaatagttaacttggtaaatgccaacagttaaaacacttcagccatggcatatatagccagaacccagtgataccccttggttatagaaaagagcagtgttttatgtttattattgaaacaggactcccatgttcaaactagaaattgtcattcaacagaacaaatcaggtcaagacaatcacgaaacaagagacaggaggatgtgctcctatgaagaaaaaaacaacaaataaccaaactttatttccttgaatataatgttgatggcaagatttgtaagaggtaatctctgtatttagtttagataaagacttccagcccaaaacactgttaagcagtaactgtgaggagctatgcagaagtgatgagaggcaagtactatatagactagaaaatttaattttctacagaattacagattactatgctatgaagcaaaagcagaccattcttaatgtatcaaattggtgagcttattaatttcaataaaaatatatgacccccatcacacaaacaggtaactctaaatctactttgaaaatctgatcagtcaagaagtattaccagtttggaggctatgtaccaagtgtcataccaaagataaggctgctgtcctcacagaatatatggggtcattgacaatcaattagaatatccaatgaagtggatattctaatatttggagaaatattggaaaactagcaaagtgccctggaaattatgtgttcttgcccttccacaagacgtatagatccagatgagattagtttggaataggggtctttttttagtccagaaaatctttagagtccaatacagttatggctaatcagagactaaagaacctttatgaaagtaagtaggattggaagtccttggaaattgagaacgcttattttgaattagcatgttttaatcaaaggtatagaattaatcaagtatcagttaagaatttctggaatgcactccaatgccagaagaccactagcatgctattttgtactatgaagatttcctgatttgaaatagaaggtaaaaaaaaatattgccagccataaaataaattttactctacttgcttagttctccaaagaaaaatcttacttttttcccataagaaactcactggatcaaatgaatgttaattaaacaaaagattgtgtaagtaaaactgggcaaaagacaacctctgaaatccatgaaagaattaatcatcaaaagagaagaatcatttttacagtagccccattgccgtgagagatattttcatgagcctgggccacctctccaacatatagtgagaacttattacaggtttcagccaaccaatttccattccagcttgacaggctgctgcaaattgctgagattcctccttggttgaggaaaatagagtaacgacaattttactagactcttttgccatagtgtcccatgggtttatttcaatggtaccactgttgccaacacctattacttatcttccatatgacaaacaattcgcatatttactaagatttatattagctattatttcaataatcacatcaattcctttcttatcacacatttcttaattttatcaacatagttaacttctttgtaattaaacactttgtgggctccattttgcaaaagtctttttgtccctcagtaccaactgtgcccaaaacctttaagacataaactctagcaatttggcatgttgctactgcagctcctccactagccccatgaaccagaacactctccagctttcatacagacactgtgaatcagagctcgatatgcagtaagatatgggataccaatggcagcattttgtttaaagtccagtttttcaggcagtttgtaaacagcgtaatctgctcccagagattgtgccggtagtgaaaactgtcacttttcttgaaagtagatgcattccctccaacagcttccgttaccccagttacatctgagcatagaataaggtggttttctattataaataccagagtaaatgtatgtctccatggggttgacaccacacgcatgaaccttgattacaactaatggtcttttggaactggtactgcaacatctgactgagtttcaggacttctggtctaccaaattcaaacactctaacagctctcaccagcttttgttcagttgccatggtcatctagataaaagctctagagtgggaatcaaaatctgcaagggctccttcatattccactgaaggaggctggccaggctgcttctaacttttgcagccaacaagacttttggagttggggttcagtttaatctaagggtgctaaaggaaccaggccagggtcagataatgtcagcagaaaaatgcaatattaggaaattatgttatttcaattcaatatttatcaaacctcctgctttgtggtgcagagtatacaaatgagcatgatgcaactcttgttctaagaaaggtggaaggaaggataaggcaagtccttaaataattgtaagtcaaggcagaacataatgaagtcctttaaagaaaaatgtaagtaaaacatgattgagtacatagaaaggagagatttcatccaaaagtttctgtaagaggtggagtctgacctggctcttgagaatgttaccctacaggtagagttggggaaggagagaattccaagagaacagaacaagatgaggtggacacagctgcaggaataactaagctggtccatttggtaatcttgttattataattgaaatggtaaaaagattcagatataataaggatgtaaacagtccacacattttaggaaatgccttgaaagacatcagcatcttacagaagtatatgatttataaagagctaaataaatgccatgtttttaaaggatggatgtataattaaattgtaaccaaagagaaccagttgactttcaaatgtaaattagggccaggcgtggtggctcacacctgtaatcccaacacttgggagccacgacaggagattgctggaggccaagagttcaagaccagtctgggcaacatagtgagaccccatttctttatttttgtttgtttttgttttgagacggagtctcactcttgttgcccatgctggagtgcagtggtgcaacctcagctcactgcaacccctgcctcctgttcaagcaattctcctgcctcagcatcctgagtagctgggattacaggtgcccaccaccacgcttgcaattttttgtatttttaatagatatggggtctcaccgtgttgaccagtttgggtgagaacccatttctaaaaaaaaaaaaaaaatttattagctgggcatagtggcatgcatctgtaatcccagctactcaggagtctgagacagggggaatttgaggctgcagtgagctgttatcacaccactgcactccagcctaggtgacagagtgagaccctgtctctaaaaataaatgtaatttagatcttgaaaccagattaaaagtttaatctctcattgctttactgccatttagtttctatggtaacatggatacatttgggattttttttaaattaataattgtttatgggacaattggtaacttaccacttcaaattaggaaaattttcttagcagttagaacttttggtggagttcagatttgcttaagtgattagtagttatctgtaaaacataatttttgtaagctagaaagcttatggccaggccggacatggtggtgcacacctgtaatctcagcactttgggaggctgaggcaggcagatcacttgagctcaagagtttgagaccagcctgggcaacatggtgaaaccctgtctctacaaagaatacaaaaattagctgggcatggtggcattgcagcctgtgcggcagtgagaccttgtccccccggaaaaaaagaaagctcatggccagacacagaaagtagagtttcagaaaagtttccatcacactgagtttagttgtgtcatgtatgatacaagagtactacagcattgcattactttttaccagtgatagttaacaatattatgaaggggtgaattatatatatatatatatatatatacacacctaggtaaataagaaccttaggccaagtataattttgttctgcttacttttgataggattaattctagggaaagattctgtttcacattatcctcccattctttacttctgaaatgatgtagctctctagaccctactgctaaggtacttattactatgatacaaaatggcctcacatcttcttccctgatcccagtgtgcgcagaccgcagaccagttgaaaccgaaaggtggactaagatgggaggcctccaaccagggagaagccactggtgttaacagcatgatctctgggcttggctattgcatccccacctgctgtctgacattgggcaggggacccgagctctttaaagacttaaaagtccttgtctgcaagatagccgtaatagtacaacacccaactcattagagttgtcttcaggattaagtgaggagtatttgtaaaatgctaagcactgtgcctggaattaccaaaggaagcttttaaaaagtcaacaacttttgagggccagatagaaatttcatattttggccgggcacagtggctcacgcctgtaatcccagaattttgggaggccgaggcgggcggatcgcgaggtcaggagatcgagaccatcgtggctaacatggtgaaaccccgtctctactaaaaatacaaaaaaattagccgggcgtggtggcgggcgcctgtagtcccagctactctggaggctgaggcaggagaatggcgtgaacccaggaggcggagcttgcagtaagctgagattgcgccactgaactccagcctgggagacagcgagactccgtctcaaaaaaaaaaaaaaaaaaaaagtcgtattttttgaggagtcggttccatcctgagcagtagccctactccactgtgcagaaaagtggctgttcagtagaaaaattttggagattctaagatgctcattttcctcccctgccttcagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtatgaagagctattgtgtcaagcttattaacattgaaatagtatttgcaggccacctatcttaagttgatgtgcctcaaagaggaagatttattaaaaactcacatgggcccaagaaagtatattatttttagtcccaaatattccattgcaaaattaacttttgaaaaccatctgttgtttcacttatcaacagattcctgttcatttggttttctgagaagctagcttcc

SEQ ID NO: 703 - DNA, 5879 bp, Homo sapiens
cggcactttcaaataactcgtaaattctacaatcctctaatttgcatcctgaatttcggtggtttgcaaagaaaatgtattagagtttattacgttttctaagattgcagtattgactttacataaatatggaatgtgttttctttgtagttgtcaaagaaggaccacggtgaatacaaggcaaccttgaaagatgacagaggccaagatgtgtccatccttgaaatagctggcaaaggtaaaagaaaacctcctttgttctgtgaacaagaaattcctttcaccaacaggatgggatgtattctgaaggcaggtctatgtctagcctcagctatagcacacattgtgtctttagcagtaacactgtagaaaaaaactatttgttctttggttgctttcagagttttttcagtgttttagaataatgtatgatattactctgggtttatatgaaacgtcatttcggtccatcatcagaagccaagcaacgcattactaatgcagttaaaatgatggaaacactgaggcagtgattcagttgaatgtagagttggatttatgttgagtaaaacgttcttgatccttttttaaaagtgaataggttagaaggatttatcgcacacataagtcttttatggataaatattgccattttaatgattcatttttcaactgaacatcacaatttcctgcatcgatttaattaaacattgaaaatgctgctttcggttaaagttacatgtcgtaatggtgcgtatcccttctcattttcagtgtatgatgatatgattttggcaatgagtagagtctgtggtaagtaaatgccttttaattttcaagtcatttggggtgctgaaatcactatttcctgacacgggaagtcactgctgcaaaagagggcaccatggagctgtggtgcgtgttctgtgggaggccctggatggaagggcagggtggtgatctgctgccgatgaagctttttaaaggacttccctcagttttgtctggagtttgagttttactttaagaaactcaggttgggcgtcctgattagccacttcttccatcctgtcttaggttaattggcatgactgctttgtatataattgctatgagcagctttttacatatgttgaatagccgtaatgaatttttaaacctctcactttgcgtcgtacacattaaaccatatgttatctttacaaataaatgcccagaggtgggattgctggatcacatgtcagttcagcttgtttttggaggaaactccacactcttttctatagtggctatattaatttacatgccaccaatcatgcacaagtgttcctttctctgcttgccagtgttttatcttttgtctttttgataatagccattctaacaggtgtgagatgatatctcactgcagttttaatttgcatttccctgatgattagagatgttcagtatttttcaagtatctgttggccatttttctgtcttcttttgagaaatatctgttcagatcctttgcccatttttaatgggttatttgtttttttcctgtggagttcagttccttatggattttgaatattagtcccttagccaatgcatagcttgaatatagtttctcccaatccatgggttctttcttccttttgtcaattgttttctttactgtgcagaagctttttagttttgtgcagtaccatttatttacttttgcttttgttgcctgtatttttgatgtcctatccaagcgatcactgcccagatccatgctgcaaagcatctcccccacgagcttccttccagcggcttcgcagtttcaggtcttatgtttaagtcttttatccaatttgagttgatttttccatgtggcataagttaaagcgccaatttcactcttctgcatgtggatattcagtgtttccagcaccactgattaaagagactgtctttccctattgtgtcttcttggcatctttgttgaaaatcaattgaccatcaatatttagtttcatttctgggctctttatcctgttccattggccgatctgtctgttctaatgtcagtgccatgctgttttggtttctgtaactatatattttgaaatcaggagtgcgatgcctccagctttgttctttttcctaaggattgtttaggctattagaggctttcctagttgcatacgacttttaggattatttttcctttttttttttttttttttttgagacggagtctttccctgttgccaggctgtagtgcagtgggtgaatctcggctcactgcaacctccatctcctgggttcaagcgattttcctacctcagtctccagagtagctgggactacaggcacgcatcaccacacccagctaatttttttgcatttttagtagagatggggtttcaccatgctggccaggatggtctccatttcctgacattgtgatccgcccgcccgcccaccgaggcctccctaagtgctgggattacatgcttgagccactgtgcctggacaaggattatttttctatttctgtgaaaaacaacatcgaaattttgataagaattgcattcaatctttagattgctttgggtagtaaaaatgtggctttactcttatactcatgaaattattttgtgttaaaatatctcataatgtgtccaagggccactcatggataatagaactgaccagaaggtcttgaagagtgagtgtttataaggaaaatgcaaaaagcagagtcctcactgtgtgcttgtcacctcgaagcagagatgcagcggctgaggggacatgcacattatgttgggagttggatagggacagaggggacaggcccagaacttcccatatcaatagggagcctttattctcatgggaaactggacgccatgggctggagtctctccctgacatatcagaatggaagaagtggaaggcatgttgtcaacacactcacacccacacactcacatccccacactcacacagcagtcacacacacacgatttcccactcagacatacacacacactgacacacaccagtgtacccacaccctacacactcacacactcatacatgcacacacttacatgtgaactcacacactgacacacacactcatacacacacttactcatatgggcacacacttgtgtagactcacacactgatgcatacagactcatacacaggagccctgggaggctgggggagcattgggggaggctgatacaggctggggaagcaccgggagaggctgatggaggctgggggagcactgagggaggctgatggaggctgggtgagcactgggggaggctgatagaggctggaggaccactgggggaggatgggggagtactaggagaggctgatggaggctgggggagcactgggggaggctgataaagtctgggggagcactgggagaggttgatagaggctggaggagcactgggggatgctgagggagcattgagagaggctgatggaggctgggggagcactgggggaggcagatagaggctggaggagcactgggggaggatggggaagcactgagagaggctgacggaggctgggggagcactgggagaggctgatagaggctgggggagctgcttctggtctgtgtgctttgctctcaggctgctccgaccctcccgtgttctgcctggttagggtggtgttggtctcatgagtcagtgtcagggaatttgagcagagggaaggggggtcgggtgggggaatatggctctgcagtgtgttgacttcacccagttcccaagctctttttcaagttgtgattccttgaagggtgaactcctgtctccgagtagaggaaacagagtcccacctgactggggaggggagatggtggtcagggatctctgccttacagattttcaataaccctcctgtctgcagccggcccagatgcagggaccctccaagtcctgagctcactcggttccctgcgcactttttggctttcttagccccgcacagttccctagacctcatgcccctccctccacctccagaagctctggggatgggctcaaattctgtcatttcctcccctgttgtccctcaggctcctgggtggtttcctcctttgcagtggactagcggggtttagggaggtgtggaagtccaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcaggcagtacctcggcgtgacgcggtgacgcagccgcaggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttggttggtgctctttctttcctcatgtgtatttaaggataaaaggaaaacaaagagcttcaccatcataacagtttctattttggtttctatttctttacatagtcggagtcacaaataccgttcatgttgtttttttcccccacatattttataattttctttgttttatatagatgttatattaacattcactttaaaaaataattacttattatttcatggaaccacatatcatggtttaagctcttttctatagagaaattaatgagtttccattattttaaataattgtacaatgcacacctttgggcaagcaaaggctctttcaggatttaggaatatgttctttgaactcctagaagcacaataactatgtaaaaactaaaagtaattttaagattcataatataaatttcaagttgcttcccaaaatgaaaaaatactatttaaaatgcctctttgttacactatcctccacaacagttggtgatcatcttgttttccattatctgtgctaattatgtaaatctagttttctaggtaactgtatgtgaatgtaaatttccaaggctgaatatctgataacaatctctacttccagttcagagcttctgccttcatcagtgctacttccttatcttctcctttctgacctctgacccatagatcatctacctcaagcgaattagtcttcatttttattccaagtacactgtgtgtgttctcgtttattgcattttcttattgcccctggggtttcttctgctttccttcctctgacccaagtttcatttgtcttgaagaaccagccgaggtgctcccatctgcttgactcccacctgaaagagtcctgctaaatcttaacgtcccttttgcagattttctacgatagttcagcttggggttaactcacgtagcatttgccatgcactgttgttattttgcctccttttcttaagcaaagctgctgaggggcagatgttgaatctttttagacagttctatatcttttacagtattctgcaaagagcttttcagataattctagcatggtaagagcttgtttaatgaatggagacagcatgggaataaagtataagaatttgtggctggccgactttatgagagacacaagtgagaacaggattgcaggtggggacaggagggcttgccgccgcgatgctttctgtgatcacacagcaagcactccttttcctagatctgaggatgttttattttctgcagggaaatctgcttcgccactgaaggtactctgcaccccagaag

SEQ ID NO: 704 - DNA, 1310 bp, Homo sapiens
gggcctttgtttatttatttttggttggtgctctttctttcctcatgtgtatttaaggataaaaggaaaacaaagagcttcaccatcataacagtttctattttggtttctatttctttacatagtcggagtcacaaataccgttcatgttgtttttttcccccacatattttataattttctttgttttatatagatgttatattaacattcactttaaaaaataattacttattatttcatggaaccacatatcatggtttaagctcttttctatagagaaattaatgagtttccattattttaaataattgtacaatgcacacctttgggcaagcaaaggctctttcaggatttaggaatatgttctttgaactcctagaagcacaataactatgtaaaaactaaaagtaattttaagattcataatataaatttcaagttgcttcccaaaatgaaaaaatactatttaaaatgcctctttgttacactatcctccacaacagttggtgatcatcttgttttccattatctgtgctaattatgtaaatctagttttctaggtaactgtatgtgaatgtaaatttccaaggctgaatatctgataacaatctctacttccagttcagagcttctgccttcatcagtgctacttccttatcttctcctttctgacctctgacccatagatcatctacctcaagcgaattagtcttcatttttattccaagtacactgtgtgtgttctcgtttattgcattttcttattgcccctggggtttcttctgctttccttcctctgacccaagtttcatttgtcttgaagaaccagccgaggtgctcccatctgcttgactcccacctgaaagagtcctgctaaatcttaacgtcccttttgcagattttctacgatagttcagcttggggttaactcacgtagcatttgccatgcactgttgttattttgcctccttttcttaagcaaagctgctgaggggcagatgttgaatctttttagacagttctatatcttttacagtattctgcaaagagcttttcagataattctagcatggtaagagcttgtttaatgaatggagacagcatgggaataaagtataagaatttgtggctggccgactttatgagagacacaagtgagaacaggattgcaggtggggacaggagggcttgccgccgcgatgctttctgtgatcacacagcaagcactccttttcctagatctgaggatgttttattttctgcagggaaatctgcttcgccactgaaggtactctgcaccccagaag

SEQ ID NO: 705 - DNA, 926916 bp, Homo sapiens
  misc_feature (564917)..(664916): n is a, c, g, or t
atggttaaaatgagagtgaagtgccttttatcacacctttttgtttaggtccatgctgagccaagaatttccatgaacagaaaaagcttcccgttgcctgaaggaagggtgaagaacatcttctgtctatcttggtttttgcataacttgctgtcctcctgaccagagacttgatgctcactttaatagctttgggcccgaggaaacatttattttgtttcttactgtaagttttactcaggatagtagagagtagggtattctcccccatgaccttggagtcctactccatggaagttattcatattgcttgatcactgtgctaatataagacaagagtcttagcttcaagggaaaactggacattgaagagatctgcctggaaaacctagggttgtttatactgtagcttctcagaatggagcagcagagcctctaacaaactcccacgctgtaactgatgtttacataaagactgatgaagaacaggagatgctattcaagattcttataaaaacagaacccattggcccagcacggtggctcatgcctgtaatcccagcactttgggaggccaaggtggggagatcattcaaggttaggagttcgagaccagcctggccaacatggtgcaactacatctctaataaaaatacaaaaattagctgggtgcagtggcacttgccagtaatcctagctacttgggagggtgaggcagaagaatcacttgaacctgggaggcggaggttgcggtgagccaagatcgtgctactgcactccagactgggtgacagaggaagactccatctcaaacaaaacaaaacaaaacacccaaaaaacaaaaagcagaacacatcaaaaagaaagggcagagaccaaccgactaatcaattttggctgtgagtaaagcagttaaatagaggagcatcacagtgacttttaggcaaccaggtgggacctggaaaatccttccctttcaccctacacaccaacctgacctaagttcacagactttgtagagtgaccttaacttcccaaaagatgtacttgtatagagcatctgaggtctccccactccccattctggttcctgctgtcggagaccctcacctcttgggtggtgcatgagaatgctcgccttcctctatcatgctctcttgctggccctccacttccaggaccaggtgtgacagcaaaagtggaagagagtcctgctaagaaaggttgctgaggcagagaaccagcccctaccacctatctcccagtaaagtggagagctctcaccaaggaccatcagatgaggaaaggcagcaccagcctgcactagcctggtaggttctttaatattggaaggactttggggcacagagaaaaatctcaccactatttacactaagtttaaaccagttcttgagtattaaatattgatacaaaggtgattatttaaattcccttcatctatattgatgtaatacatttagtatgcctaattgtttttaaacacatctaataccttaaagaatagataaacatattcctgaaagacaatcacaaacttattcattcattataccaaaaatgatacagaagggcccatatcatggatttgacatcttttctcatttgttttgagtttactccttcctatgatttttgtgatcttccgagaccccaaatgactaaacgaggttgcaagtctagggccaaatagctgacccttgatcaggaaacagtgctttgcatgtgtctaagatgaatcaaacccagactacttgttatttattatcaggctgagactttttgttgttgttgtaataaaaatgtttggttttttttgtcatgtcatgacactgttcaatccctgtcttttatataaattttaattctagaaacttgtttttctcacaaatacgtcgttcttaagtttttgcatagccctaagtgtatggccaattttcttatcattatgatgtattgacttggttcattggcataattaaaaacatattaacatatattttctcactagcattttattaaaatgagtatagctttattataataaatagagttcatatgcttgaagggatggagagttgagaccaactccttcattaaacattggtctaattaaccttttggggaccagtgagggaccatttgtctcattggttattgggcctcgtcctctatggtcaccagcttctgagctcctcttctatctggttattaattgagatcactgatgcttgtcagtctttcttgttttgggcacagttttaactttttccttagtaaactttattttattctatcttgttgatacagttatatatcaccaaaacagagtgaaataaagcttaatgtaaagtgtatatatttaacacatctgcttaaaatttcaaaaattatgtatagcaatgctttcccactttttaaaattaaaggacaagtaaacatagcccattagatctatctttcctttgagccaacaaccactttttgcctctcattgtaaacttctactttttgagtatcattaggaatgcattgaatttttaagtttcaaactattccaattaacacttatatcctgtcaggaatggtggctcaagcatgtaatcctagcactttggggggctgaggagagcagatcacttaagctcaggggttcgagaccaacctgggcaatatggtgaaaccctgtctctacaaaaaaatacaaaccattagtagggtgtggtggcacatgcctgtagtcccagctactcaagaggctgaggtgggaggatcatttgagcacaggaggtcaaggctgcagtgagccgagattgcaccgctgtactccagcttgggtggctaagttagacactgtctcaaacaacaacaataaaaaacccaattatattcatttttgttattttgttattgctctatgatgctcaaattgtgcatcattggaatgcaaagaccagttaacttaatgtagatcagaattctcaatacaaaggaaccatacaaaccaccatataacaaagcaaaagaaaaaaaaggaaaaagaaaagaaaattaaaaaggtcaaacacactaagtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatgtgcaagattgatgtctcctacctgaggttctaagagcagagagtccatttcctgcaaaggagatagcaaggtcctggttgtcttccccagactgcttctgggttgtagcctcatcagctctttcctggagtgactcagcctgggcctgcagggccaccaggagaatggcagcaaggatggcgatggtcctcatggctggggtcacctgcaggagggagagcaggagtggatatgtggggagtgaggagtcagcctggatttatagctctgctgggagaagacctgagacagaagctgcagtgagaggaggtgggcatgtgattgggaggggaaggactgcctttgttctcaagatccctttgatgctcctctttctcccagctttcatcaaagcgtgagtctgtatgcttaatgcctcttcttgatccaaggtgttaatgatgataagggtattactatcctgttctgtttcccatctgcttgagtatttacttttatatattcaaaaaagaaaaacaacagcgctttcattcaagaagtttggggatcaaatgcctcttgttttctgaagatggtccctggtactctctggatgactctctgggggcagacctgggactcagtggagtagagagttaattcattgcaggattcagggatattactaacctcatgtaggaggcttttgagatctcgaggtgagtagtctcccgctggtgccagtatggagaggtcaatgaccttatcaggctataggggaaatgagttcagtaaaatagtaggccaagtttatcagattaaaataaaaattcggatttagttcaaggagttggtgtgatctgaatgcatcacataaaatgtgtagcgggtacttctctccactttggggaatatcaaagtaatttaggtgcgtacagcccctttctgagattttttttttagttttagaaaattgtaaatcatgcacaaggaacaacattcaaaaggtagaagtcatgagctctcatttctacccccaggccttcagttctgacccagcaaaccatcactattaacagttacacatagtattctgcacttcgcttttttcacctgtaacattggcactttgtatatcaaaatacatggaatgctattataattttaatagccttatactatcccagggtttgtatatgccatcacttattttttgtactgataaaatattataaaattattacaatttggttatttttaaacttttgcagtaataagtaaagttacagtgattatcttgtatatatgttctcttacctatatggataaacttatagaaatagaattgctgtgtcaaagaatgcatcttaagccagcatggtggtacatgcctatatttctagctatttgagaggctgaggtgggaggatcactggagaccaggagttcgataccagcctaaaaacatagtgagacccctttctcttaaaaaaaaaaaaagagactatatcttacacatttttaagatattactacatatttccataatatcaccatatttgatccaaatcctttggggctcagtgggcccttggagagtctctatatttgaattcctcatttaatttttttcaaatttatttatttattcattgaaaaataattttctgtatatttgtagggtatgatgtgacgtttggattgatatccacatgggagaaacacataagctaattaagatagccatcacctcaccaacttaattttttaaggagaattacaaattgattcctttagcagtttgaaagatacaatacatcactattaactgtggtcaccgtgcagtgccatagatcactaagactctccagcataactgaaactttgtactcttggctcaacatcttctcttttcctatctcacccacctgcagcttctgatgaccacctttgtactctagttccataaaactgacattttaacattccatgtgtaagtgatatcatatagtatttgtcttcctgtgtctggtttatttcgtttagcacattgtcctttggttccatccatgttgtcatgaatgaagaatttccttcttttttttttttttttttttttttgagacggagtcttgctgtcgcccaggctggagtgcagtggtgcgatcccggctcactgcaacctccgcctcccaggttcacgcctttctcctgcctcagcctcctgagtagctgggagtacagtcgcccgccaccatgctcggctaatttttttgtatttttagtagagacggtgttttactgtgttagcgaggatgatctcgatttcctgacctcgtgatccgcccgcctgggccacccaaagtgctgggattacaggagtgagccaccgcgccctgccaatttccttcttttttaaggctatatggtataccatcttgcatgtataccatattttctttattcattcatccactgatgaacatttaggctaattccatatcttgcttattttgaataatgctgaaatggacatgggagtgcagattcttctttgatacagtgatttcaatttcttgggagatatacccagaagtgggattgctgggtcatatggtaattctatgttcagtgctttgaggaaccgccatactattttccaaaatggctgcactaatttacatttccaccaatggcctacaagggtccccttttttttatatcctcaccaacacgtattatttgtctacttgttaaaagccattctaacagatgattacctctttatgattttaatttgcatttccctgataattagtgatgtcgagtgtgtttttcatatatctgtgggccaggtttattgcccttttttaaattgagatgtttgttttcgtcttattgagtgtttgaattccttatatctttgggatattagccccttatcagatatatggtttgcaaacactttctcctagtccctggatcatctttttgtttcctttctgtgcagaagttttttagttgatgtaacctccttggtctatttttgattttgttgtctttgcttttggagtcctgttgtagaaataattgcccagaaaaatgtcataaagatttccctccatgttttcttctagtagatttacaatttcgggtcttttatgtaagtctttaatccattttgagttgagttttgtgtatagtgtgggataagtgtccaatttcattcttctgcttgtggatatctagttttccttacaccttttagtgaaaagactgtcctttccccattgtgtgttcttggcatctttgttgaagatcaagtaatcataaagccctgggtatagttttgggctttctactcctttcctttggttattgtgtctgcttttacaccagaccatgctgttttgcttccaataactttatgatacattttaaaatgagagagcatgatgccgctatctttgttatttttgctcaagattgctttggctattcggggtcatttctgatttcatgccaattttagtatttttttaattcctgtgaaaaattgcattggaattttgatggggatctacagatcactttgggtagtgtagacattttaataatattaattcttccaatccatgaactcaagatatctttccattcatttgtgtcttcttcagttttattcatcaatatttatagttttcagtgtacagatctttcacttttttggttaaaattacttctaagaattttatttttgagtgctattataaatgagattgtgtgggcttctaaacctttgtgccagtccaaactcctgtctttattcttagtgactcctacaaaattagaaagtgtcaagtcatgctattgccttgagagagtgggagagaagccagacctttagaatacagtggagaggttggggtgtttgatatgtgtttcagttttttctttctttgcagagaaactgatagagtttatctcccacttattctgccttatgaaaatgagaggatctgaattaaatctgtaatatctataatatttatttgaattcgtgaattaacagggagcctgggagggactaatttcctgcatcagtgattccaggtttcatggcccttgttttgccctggtggccatttagcaccaggttttaaaccatctgtatttgtactgcttctctatttctcactggacattgctaagtttgtagatagcgttccacaattgtttcctagcctccgtctctctggcattgtctctctgaatctctagcaatgactgaagaaacaatttgggacatttttgttccagttctaacctttctccatgaattctctcatgtgtttgatcacccagagtccttattatttggagaaattgatatcttcagtctctcttcatccttctctgaccccaaaattaattgggtgagcagaaaatctggaaagataaatgggtggtttaaaaaccactgtccaggccctgtggtgtgagaggcagagctgagcactggccaagccagaagatgcccggtggcccatcttcccaggaccaggccctcaccggcagcccattgctcagccttagacacaactctgttgccagtcaagtttctcattatctctggcagaagtatttctagagaactccactgggctgggcgcaatggctcatgcatgtaatcccagcactttgggaggccaaggcgggcagatcatttgaagttaggaggtcgagaccagccttgccaacatggtgaaactccatctctactaaaaatacaaaaattatctggatgtggcagcgggtgcctatagtcccagctactctggaggctgagacacgagaatctcttgaacgtggacagcagaggttgcagggagctgagattgtgccagtgcactccagcctgggcaacaaagcgagactccatacccccaccccccccaaaaaaaaagaaagaaagaaaaagaaaacggcactgacattatggaaaataattttagtttcttaatgcgtttgtaaataatcatttagaataaaatgcctttcctgttcccttttttctttaactgtagcaaagtgcccattatctattgtccccttgacttcaaacgtgctgtcatttaaaataaagtctgaaaaactatttttcttgtcctttattctgagtccaatcttgcctctcctatactcagcgctgggacaaaaacaggatttccatccataatatggacattcactcttaatttccatacataatatggacattcactcttagaaggcatgtactccctgggcgatgatttaattatttaacataaaaattaatttaactgtgctaaaaactaaagggcaagggaattggcctgaaagaaaatacttcagatagcaacagaatctggttttataatagaggttttgtattccaggatattccaggggacaaacaatgcttagatgtgtgtttattactggtaacagtcaagcagatgggagacagggagagtgataggggccttcatgaacgtgaagagcaggtgtttcagtgcagctgctggattggagaatcatcaaaggtctgaaccatcaacccaaaggatacctctatcccacagccacgcaggtttggggtagctcattgccctgggatgctgcttcctccagatatcacagagctggggtctttttactccccttggtcctcaggctccttcggtcccttgagagacagtgacctctaggaggctcacagccctgagagcctttccccttgtccttctctggagcctcttggagaaagctcaccaggtcctagccttgcagcagcctgggacagaggacccagatgtagctgtcccctttgcaggagtgaaaactgcattatgggcttcgggtaagacaatgtgctgtctgttgggagctgcagtctcagtggtgccatcaactagctgtgggatcattagtgcatgacttcacctatcatggcctctgtctttcaactctaaattgggggcaatagagtctctccaaggggtcttgggtgcaagaccttgaaacccttgaaagattaatgtatgcagttcatcccgcaggcacgagcagacaactaggcaacaaataacagccacttaaagctttcttagcctaagctgctttcagaaacagcctgtcaaagtttctccaggctctacggtgcctttgaatatcacatttttaaccccaaagtccatgtaattcattctggcaatcacccaatattattcaaatttcatgtagttcattcaggcaatcacccaatattactgaaattttaatcttctcttagaatactcattctccatgaaatcttttccaaatgtatagtgctaaatgctgtcaatttcagaatgattcctgcatttatatcttcagctccaaccacccagctgaattccagactctggaacacatttcctgtcgtgtgcgctagaatctccaacagattcctcacccctaatgtccaaaactaaactcttcactgtacatctccccagcttgcaggcaccacacacacatacaggtgttgtcatttcagaaaatggcaccagtgtctctgcagttgttcagggcaaaaaataaaaatattcttcagatatcctaatattccatattcttacatcagcaacttctgttgcttctgtaccttcaatataaattttgaatggggccatttcttatcccctgcactgccagcaccctggtgcaatatacactggcttctcatctgggcttcctcagcccccttgtaactgggctcccgctgatactgggctctgtgctgcctctgagcacccgttttccagagctggtcaatacccctgtctagcgaggttctttcccagccattttcaagatgcaacacccaggtactaagtcctgacaggcactaatctccacggttctccaggaatgaacaaataagggaataaccacacatatcccatgtatccacaaacgtagtgcctttttttttttttaaagaggatgggtagctcattgtcctttcttaaagaagcactacgtttgtggatacatgtggatacatagcatgtccccaaagctatgctcttgcaattggtgtccagcagcctctgaacaagtgaggaaggttcatccaatagtgcaaaactgggctgtaggtgcccaccaggaggagccagaggtcctcatgttcatgaaggcccttatctctctccctgtctcccatctgcttgactgttaccagcaataaatatggtcatgtctaaccatcatttgtcccctggaatatcctggaatacaaaacctctattataaaaccggattctgttgctatcttattttcttccaggccaattgtcttgcacattactttgtaacacagtcaagttaattcctatgttaaataattaactcatccgtcaggggagtacatacattctaagagtgaatgttcatattatggatggaaatcctgtttttgtcctggccctgagtgacctggacaagtagatctttctaccctgagatccagctcctcagggtagaaagtgcagagctgacatctctatgaaaatgaccagggcaatagaaacaaaaaggtaagaaaaaaggtaaagaaaaaaataaggtaaagaaaaggggggactacatggcccaaatacattgagcttactgtgaaaactcatttttggagatagagagaagataaagaacaaggaagagagactaaattgttcgtttccaggttttcaaatggaatcttgtcctgatttgggtctcaattaacaaagcacaaggacagctgagcctgtaacaggtgttgctgaggatacaggaccgagagtgatactcagtggcaacatgcaggtctgcaactgcaggtgcctctcacctggtgacctgcaggaagatggaggagcatattgggcacagtgctcggtttgggggtacgggaaatcagatcagagcagcccagaggaggactgtgttctaatagagcaggttctaatagagcagaataaagagatcataactggccatctgtcggccattcaagatctggtgcttcctttcatgttttctgtcatttatatcacacagtccccactccctgcacacaggcactgagactcagagacatgcacatgcacgtctataacacatacatccccagtttccacctcacaacacactccactcaccacacaggcgtgcacatacctgcacaatataaacatacaaacatatgcacaggtgcacgcatgcacacacaccctgaagtgcagactccaaactctaatatatctggtttagtctctgaggctgaagctgctcagagggcgcctcccgcgatgcggggagtaatatctccccctctcccccccgggctattaccagccacatcacaggggggtgagggcgccccccgcgatgcggggagtaatatcgcccccctctccccccttgcatattacgagccacggtggtcacacagcgtgttgacattattgtcaataatatcttctctccctctggaaatgaccaactagatcacagaccggtgtacatcctcttcactatttgtagtaatagcatcctcttccccctggatattaagaacagtatcacaggagtctttctacccccagcggcattgggtgtagtatcgtcctctcccacgttgaaattatgaactatatcactgggggtgtgtccaccccatgcgatattgatagtagcatcatcctcttctctcctggatcaggggagcaatgtcactggggtggtgtacactttctgcggtatcggcagtaagatcatcctctccgccttggaatatgaaggaccatatcacaggggggctgtacacaccctgcgctatgaagacgaatattatcctctcccaccctgcacatgagaaaaaatatcacagggtgggtgtacaccttctgcgatatgggggggaaatatcttctcttcttctggatagtaggaacaatatcacacgggtttgtacactttctgtgatattgggagtaatatcaacttctccgcctttgaatattaagaacagtgtcacagactggatgtacaccccctgcgatattgggagtaaaatcagcctctcctctccatggatattaggaataatatcccagaatgggtgtacacctcctgctgtatgggaagtcatatcttcctctcccttcctggctactaggaaccatatcagagggtgggtgtacacagcctgcgatattgcgagtaatatcaccctctacccctccggatattaggaacaatatcacagaaggggtgtacactttctgcgatactgggagtcatagcattgtcttcttccgtgaatattaggagcaatttcaccgggtggatgtacacccactgctctattgggagtgacgtcatattccaccccctggagattatattcggatcaatatcactgggtgggtgtacacctactgcaatattgaacataatatcatgctctctccctccctggacattaggagcaatatcacaggtaggtgtacacccactgaggtattaggcgtaatattcatattcattattcctcatttattagtcacatgaatatgaattaccaatattaatattaataacaaattgctgataaaaagtgttcaaaatattaatattaattattaggagctaatattactgttttctaatgtataagatcaatatcagttattaatatcaggcattattaatcattaatattaatcatttattgttatcattcgtataactatttaatattaattatcattattattggtattgatgttaaaaattatattttcagttattaatgtcgataattattagtatcaattaataatggatgttattaattgcgataagtaatattgatattaaaatcgatattattgattatcaattattaattgcgataagtaatattgatgttgaaatggatattatttattattaattattaattgcgataataatattaattgcgataagtaatattgatattgaaattgatattattaattgtgacaagtaatatcgatattaaaatggatattagtgattattaattattaattgcgataatgatattaattgcgataatgatattaattgcgataagtaatattcatattaaaattgatagtattaattgctataagtaatattgatattaaaattgatattattaattgcgataagtaattttgccccattccacataatatctgtgatcttgttgctaatacccaggcggggagaggacgttattaatcccaataatccggaaggtgtagacctcccctgtgatattgtccctaatatccaaaggtggagaggaagatatacctcccaatttcgcaggggttgtacaccacccctgtgacattgttcctaatgtccaggggtagagaaaatgacatgactcacaataaggcagggggtgaacaccccgtccatgatattgttcctaatattcaggggggaagagtatgatgttactcccaatatcacaggcggtgtactccccatatcccaggttgtggatagtatcccgatctgtgatagactccgccacgatgtggggagtaatgtcatccccctctccttccctcggtattacgatacacatcgcaggggggcgggcgacccctacgatgcggggagaaaaatcaccccccacccctgatattacgagccacatcgcaggggggtggacacccccagtgatgcggggagtaatatctatcccccttccccatggatattaggagccacatcacaggggcgtggacaccctccgctgatgcgcagagtaatatcaacccccatccctccctgcatgttagcagtcactgaggacacacagtgtatttaccatatttccagtaagatcatcttttcaattgaaccttatgaacaagatcacagaggggtgtacacttcctgcgatactgggggtaatagcgttctctcctccactgcatactgggaacaatatcacaggggtgtgtattcctccttccatattgagagtcatatcatacttgccttccatatattaagaacaatagcaaagaggggagtggacactgtgacgatattaggagtaacatcattctctctacccctggatattagtagcaatatcacagggggatgtacatttcttgtgatattgagagtagtagtattgtcttccccggtggatatgaaaaacaataccacaaggggcgtcaaaccacctgccaaatttgagggcatgttatcctctccgcccccggatattagagacaataacacaggggtaatgtacacccactgcttgatcgggagaaggatcatcctctcccttcttggatattaggaacaatatcacgggggtggggggggggtgtactgcctctgcgatattgggagtaaaactctcctgtcttcccctggatattaggaagtgtatcagagggggagggtgcacattccctgcgatattcaatgtaatcttatgctctccctcccagggtatgaagaacaatattacaggaggggtgtacaccctctgcgatattgggagtcatatcatcctctttcgctctggatattaggaagaatatcacagggctgtgtacaccccctgtgatattgggagtcatatcatcctgtggccctgaggagagaaacaatttctctactgtctcctgtctctgaagaggaggaggaagtaaaagtgggaaaacaacaggaatgaagtcagtggcaagaccagccggtggcactgatgagccggtctgcggtgaaaagattaacccccccttagattaaccctaagcacatgtgctctgaatccatcacggccctttcacgtggaaccccttggagttgtaagcccttaaacgggccaggaactctgtcttccttggaggagctgggttcttaagacaagagtctgtcgatactctcggccgagtaaaaaaacctcttgcttcttgaatctgctgtctgagggacttcgtccacggctcatcctacttcatttcttagtgccctgattgggaatcaaacgggggcagcagcggtaaaagcaccgaatcccaaccactagaccaccaggggaactttgaaccttggggaaaatagattgcccaccattagaagtgggtcggccatcagaaggaagcctggacaggtcccttgcttctaaggtgtggcacaaggtaactggtaaaggacacctagaccagttcgtatagacacttggtgacagctggtgctagactccccacagtggctaagagggcaggcagcggaaatactagtagcaaagggacagatagctaaggaaggatcccgctccacccgcccagggaaatcaactcctgaagctctattccacccagcgtcagaagatgcattgcaggagatggcaccagagatcccagtggtgccctccccttagcagggaaagaggctccccactcttgagcccacagtgcttgcgcctccgcaagacaagcgtatccctaggccacctagagtagacaaggacttgggagaaacccctcccttggcagctcatttacaacccaaaaccgggatccaaatgcccctgagagagcagcggtagactgctatagttgaggatggtcacgtggtggagagacgtgtttttgggtaccagcccttcacctctgctgaccttctcaactggaaaaataataccccgtcctataccgaaaagccacaagctctgattgatttgctccaaactgttatccagacccacaaccccacctgggctgattaccacccgttgctcatgttcctctttaacacagatgaaaggcggagagtcctccaagcagcaactaagtggctagaggaatatgcaccagctgattatcaaaaacccagagagcacataaggacccagttaccaggaaccgacccccagtggaacccacatgaaagaggggatatgcaaagtctaaactgagacagggaagctctcttggaaggattacagaggggagctcagaaggccacaaacgttcacaaggtctctgaggtcattcagggaaaacaagaaagtccagcacaattctgtgcgagactgtgtcaggcctatcgtgtgtatactccctttgatccccagatccctgaaaatcagtgcatgattaacatggctttagtccgtcaaagcgcagaagacatgagaagaaaactgcagaaacaggctgggcttgcagggatgaatacatcacaatgattagaatagctaaccagatgtttgtaaacagggatgcagtaagccgtaaggaaaaccgcaaagagaatgaacgtccggcctggagaaacactgacctgtttgttagctgcagcaatcagaggggccccccgagagaggcaagggaaggggggccctgggacagaaactctgcttggctgtcagagtttgcagtgtaaccagtgtgcttattgtaaagaaataggacattggaagaacaaatgtcctcagctcaacagaaaacaaggtgactcagagcaggaggcctgggacaaggaggaaggggccctgctcaacctggcagaagggttattggactgagggagaccaggctcgagtgtccccaaagagcctctggtcagaaggacagtctgggatagagacattgattttcttgtagataccggtgctgaacaatcgctagtaaccgccccggtcacccccttatccaaaaagactattgacatcatcagagccacgggggtttcagcaaagcaagctttctgcttgccccgggcttgtgctgtaggaggacataaagtgattcatcagtttctgtacatgcctgactgtcccttgctcttgttgggaagggacttccttagcaagctgagagccactatctcttttatagagcatggctctttgctgctaaagttgctcagaatgggagtcattatgactcttatggtcccccaagaggaggaacggagacttttctgaactaagccgggccaagagataagaccagctctggctaagcggtggccaagagtatgggcggaagacaacccttcaggattggcagtcaaccaaccccctgtactcatagaaatgaagcctggggcccagcctgtgacggaaaaacaggacctggtcccgcagagaaactcttcaagggatccaggtccatctcaagcacctaagaacttttggaatcagagttccttgtcagtctccacggaacactccccttctgcatgttcccaagccacagaccaaggactacaggccggtacaggatttgcgcttgcttcatcaagctacactgactttacatccagcagtacttaacccgtacacattgctggggttgctgccagctgagaacagctgcttcacctgcttggacctgaaagacgctttctttagcatcagattagcccctgagagccagaagctgtttgcctttcagtgggaagatccggagtcaggagtcattactcagtacacttggaccaggcttccccaagggttcaagaactcccccaccatcttcggggaggcgttggcttaagacatccagaagtttcccaccagagacctaggctacattttgctccagtacgttgatgactttttgctgggacaccccatggcagtcggatgctccaagggaacggatgccctactccggcgcctggaggactgtggctataaggtgtccaagagaaaagctcagatctgctgacagcaggtaagttccttaggatttactatctgacacggggaacacagcctgggatcagaaagaaagcaggtcatttgcaatctagcagagcctaagagcagaaggcaggtgagagaattcttagcagctgtggggtttgtagactatgggtctcaaactttgcagtattagccaagactttgtatgaggtcacaagggggcggggactgggaaccgtttgaatggggatcccaacaacagcaagcctttcatgagttaaaggaaaaaatgtatgtcagccccagccctggggctacccgttctgacaaagccttttccattttatgtgtcggagagagaaaagatggcagttggagttttaacccaaactatggggctggggctgaggccagtggcctacctctctaaacaactagacggggctcctaaaggatggcccccatgtttgagggccttggcagcaactgccctgctagtacaagaagcaaataagctgactcctgggcaaaacctgaacatacaggccccccatgctgtggtgactttcatgaatactaaaggacatcattggctaaccaatgctggactcaccaagtaccaaagtttgttctgtgaaaatccccgtataaccattgaagtttggaacaccttaaaccctgccaccttgctcccggtatcagagagccctgtcgagcctgattgtgtagaagtgttggactcagttgattctagcagacctgacctccgggaccagccttcggccatccgtagactgggaactatacatggatgggagtagcttcatcaacccacaaggagagagaggtgcagggtatgcagtggtaaccctggacactgttgttgaaaccagatcattgccccagggcacttcagcccagaaagctgaactcattgctttcattcgggacttagaactccatgaaggtaagactgtcaacatttacactgattctcggtatgcctttttaacctttcaagtgcatggagcattctagaaagagaagggcctattgaactctgggggaaaagacataaaatatcaaccagaaatcttgcaatgatttgaagcagtatggaaaccccacaaggtggcagttatgcatcgcagaggacaccagcgagcctccaacttggtgggcttggggaattcccgcgctgactcagaggctcaaaaatcagcatctgcccccttccgggcatcagtcacagcccctctgctccctcaagcacctgatcttgtacctacttcttctaaagaagaaaaggactttctccaggtagagggaaggacaagtgatggaggaaggatggattcagttaccagatgggagagtagctgtgccacagctactgggagctgcagttgtactggctgtgcaggaaaaaacccatctaggtcaggactcactggaagagttgttaggccggtatttctacatcttgcatttgtcagctcttgccaaaacggtgacccagccgtgtgttacctgccgacagcatgatgggagtcaaggtccagccgttccgcctggcatatgagcttatggagcagccccctttgaagatatccaggtagacttcacagagatgccaaagtgtggaggtaacaagtatttaccagttcttaggtctacctactctgggtgggtggaggcttatccgacacgaactgagaaagctcatgaagtaacctgtgtgcttcttcgagatcttattcccagatttggactgcccttatggatcggctgagataacgggcctgcatttgtggctgacttggtacagaagacggcaaaggtattgcggatcacacggaaactgcatgctgcctactggcctcagagttctggaaagttggagcggattaatcggactatcaaaaatagcattattgtcttctccgctggttattaaaaacaataacacaaggggcgtcaaaccacctgcccaattagagggtatgttaacctctcccctcctcctccaccgcccccatatattagagacagcaacacaggggtgatgtacacccactgctttattgggagtaatatcatcctctcccttcttggatattaggaacaataccacagtgcgtgtatacgtctgtcgtgaaattcgatataatgtcatcctgtgcctccctagatatgaagaacaatatcacaggggatgtacaatttctgagatattgggagtgatatcatcctctcccctctggaagttagggacaacatcacaggggtagtgtacaccctctgtgatgttgtgactaatgtcatcctcccgccccctggatattacaaaccatatcacaaggggcgtgtacacacacttcgatattggtattaataccgtcctctccctctttgggtattcggtgccatatttcaggtggggtatacgccacctgcaatattggaagttctattattttctccccccgtggatattagcaactatatcacagggggtgtgaaaaaccccctcgatatttggagtaatatcggtcgtctcccctcatgaatgttaagaacaatatcgtgagggggcttgtacaccccctttgatatttgatatcatcctgtttccccctggatattaggaacaatgtcaggaagggatgtacagaccctgcgacacttgctgtcatctaattgtctctcccctagatattaggaaaaatgtaactggggatgtgaacagccctgcgatattgggaggagtatcatcctttccccccttgcgtattaggaacaatatcacaggtggggtgtactgcctctgcgatattgggtgtcaaattatcctctcttcccctggatatgaggaagggtatcagagggggagggtgtacattccctgagatattcaatgtaatcttatcctctccctcccagggtatgaagaacaatattacaggaggggtgtacaccctctgcgatattgagagtcatatcatcctctttcactctggattttaggaacaatatcacagggttttgtacaccccctgcggtattgggagtaatatcatcctctctccctctggagattaggaagagtatcacagggctgtgtataccccctgcagtagtgggagtgatatcatcctctctccctctggatgtgaggaagagtttcacagggatgtgtgcaccccctgcgatactgggagtaatatcatcctgtcgccctctggatagtaggaagagtatcacatgggtgtgtacactccctgcaacgtggggagtaatatcatcctctgccccctggatgttaaaaagcaaatcacgggggttgtgcacctgctgcgatattgggagtaatatcttcctctctccgcctggataataggagtaatatcacaggggtggtttacatcccctgcgatattgggagtgatatcatcctctctcccccaggatattaggaaaaacatcacaggggggtgtccaccccctgggatattggtgtcaaaccccctgtgatatcaggagtaatatatcatcctctggccctctggatattaggaacaatatcacggggtagggggtgtacaccgtgctatattgaaagtaatatcatcctctcctttagaaacgaaatcacagtgggttgtacagctcgtgcgacattggtagtaatatcgttccctccttgcctggatattaggaaaaatattacaagggggttgtacaccacctgcgatatttggagtcatatgattctttgcccacctggatattaggaaaaacatcacggcgcgggggtcgtggaaaaccccggctattttgaaagtatcatcccctttttccccggatactatgaacagtatcacaggagggatgtacaccttctgcgataatgggagtcatattatccgctccctccctgaatatttagaaaacgtcacagtggggtgtacacccctgcgatattgggagtaatatcatcctctccatccaggaaatgactaacaaggtcacgggggggtgtactccccctgtgatactgggagtaatgtcgtcctccccaaacctggatgttagccacaggatcacaaagggggtgtacacaccctgcgatattggaagtaatacgatcctctccccccggatattgggaaaaatatcacagtgcgggtatacatttcctacgctgttgggagtaatatcattcttttcgtctctggatgtcaggaccaatatcacagaggtggtgtacatttccttcgatatggggagtaatatcatcctctccctgctgggatattaggaacaatatcccagggttgtccaccctctgcaatattgggagtaatatcatcctctgtttccctggatattagacacaatatcacaaaaaggtgtacaccccctgcgatattgggagtaatatcatactctccttccctggatattagaaaacagtatcatcagaggtgaacaccccctgcgataatgggagtaacattttctctttttttcttttctttttcttttttatttatttgtttatttatttttgagacagagtttcactcttgttgcccaggctggagggcaatggcacgatctcggcccattgcaacctctgcctcctgtattcaagcgattctcctggctcagccttccgagtagctggtattacaggcatgagctaccacgcctggctaacttttttttttttgtatttttttgtatttttactagagaccttttttctccatgctggtcaggctggtcttgaactcccgacgtcaggtgatccgcctgcttcggcctccccaagttctgggattacatgcatgagtgaccgcgcccagccagcacttaacatttttatttgacatctgttgaagttatagatttatacacacattgattgctgttttattatacactcgcatatacataagatgggaaatagaaaagaataaaatgggcacagtatccctaaagtttcacgttctgagacattttaaaactatatgctttttagaaacttgtttcaattaagaaactctggtatacacacacaatgaagtattattcagcctaaaaaggaagaaaatcctcttcactgcagaaaaaatgggtgagattgtaggtctctatgttaagtgaaataagccaggcacagaatgacaaatattacatgtcctcacttctttgtaggaacaaaaaagaaaatcttgcccaggtgtggtggttcaggcctgtaatcccagcgttttgggaggccgagtcgcacggatcacttgaggccaggagtttgagacccaccctgccaacatggtgagaccccatctctactaataacacaaacaatgagccgggtgtggtgacgtgtgcctgtagtctcagctactcggaaggctgaggcccaagaagcgcttgaacccgggaggcggaggttgcagtgagcccggattgtgcctgtatactccaacctgggcaacagaaagagactccatcccacacacacctacacacagaaggaatctcaggaaggtggagagtataaagggggttagcagacgctaggaagaaaaggggtgggatggggaatgaagacaagtggataattgggccccaaaatacagaaagatggaataaatgagttctagtgtttgatagtacagtatgaatattttagttcacaagaatttcttgcatatttccagatgctttggtaagaagcttcctaactttctcattatgctggtttttaagctcttctctttctgctcttgatatcgtgctggtttttttgtttttttgttttttgttttgagatggagtttcactcttgttgcccaggctggagagtaatggtgcaatcttggctcaccgcaacctctgcctcctgggttcaagcgattctcctgcctccacctcccgagtagctgggattagaggcatgtgccagcatgcccagctaatgttgtatttctagtagagatgagggtttctctctgtcggtcaggctggtcttgaactcctgacctcaggtgatccacccgcctcgacctcccaaagtgctgggattacaggcgtcagcgactgtgcccggcacatgctgtatccttatctgttgtctgttgttgtttgtttgtttttgagcccagaaataacttctcacctatatgttcaaatgatttttaacatgagtgctaagaaagctcattggtggaaaagcagccttttcaagaaatggtgtcggagaaacttgatttccacatgcagaagaatgaaggtggactctaagtcacaccaggtgcaaaaattaacacaaaccagatcaaagacctaaccccaagcactaaaagtatcatatgcctaaaagaaaacattggccacactttcatgacatcagattgggcaatgctctctgggatatgacaccaaaagcataggcaacaaaagaaaattagattccttggattacatctaaatgacagacacttttgtgcagcaaaatcacggcaaactgagtgaaaagataacccatggattaggaaaaatatttgcaaatcatatatctgaaaagaggctgatatccatcatatataaagaatggctagaactaagcaacaagaaactcaaagcatcccatcaacaatggtcagaagactcgagtagacatgtccctaaagaagatatcacaatggccaataagcatctaaaatgatgttcaaaatcactcatcatagggaagcgcaaatcaaaccaagaatgtgataccacacatcaggatggatatgataaacaaacaggcattggtgagactagagggaagtaggaatgctcgaatatgatcggagggaatgtaaaaccgtgaaggaacggggaaaatagtatgatgtgtactggaaaaatcagaagcagaatgatcagatgttcccgcagttgcatttgtgggtacctaccaaaaacaattagaagccaggagtgtaacacagatttgtgtacacccatattcatagcagcattattcacaacagccaaaatgtggaagcaacccaagggttcatggacagaaaaatggaaaagcacactgcagttcattcataccgtggaagactattcagccttcaaaaggcaggcacttctggccggcgtggtggctcacgcctggaatcccagcatcttggaagaccgaggtggatggatcacctgaggtcaggaattcaaggccagcctggccatcttggtgaaaccctgtctctaaagaaaatgcaaaaaattagatgagcgtgggggcatgtacctgtagtcccagctactcgggaggctgaggcacaagaatcgctcgaacccgggaggcggaggttgcagtgagcccagattgtgccactgcactccagcctgtgtgacagagtgagactccatgtaaacacaaaacaaaacaaagtcaaactaacaaacaaacaaaaaacaaaataaaaaaaaacagacaggcacttctgatgcaggccgcaacatggatgaaacttgaagacattgtcgtcagtgaaataaagaaatcccaaaaggataaacacgaccaggctcagtggctcacacctgtaaccccagcacttcgggaggctgaggcaggcggatcacttaaggtcaggagttcaagaccagcctggccaatatgatgaaagcttgtctctattaaaaatacaaaaattagctgggtgtggtggcacacgcctgtaatcccagctactcaggagactgagacacaagagtcccttgaacccgcgatgtggaggttgcagtgagccgagatcacaccaccgcactccagcctgggtgacagagaaagactgtctccaaaaaaaaaaaaattaaacacggtatgattccacttatctatcaagtgtctagagtagttaaactcatagagttgcaaactagaatggtgacccccaggggtgggtgagagagaggagtggagaggttggagaatgggtgcaatttccattttgaaagataagactctttcagagatgatggcagtgatggttgctaaacaatgtgaatgtacttaatgtcattaaactgtaaactgaaaaagagtggaaattgtaaatgtgtatactggccattctatatgaactaatatatatttataatttttaatatttatacgtggtatattttcccataataaaagatgaaaattaaaacagttggatctttaaaaagaaaagaaagaagcgaataatacacaccagctttctcctgattagaggaagagccccaaagcttctatgcacattcacttttctcttcttcttcttgcattattatgaggaaattcttagaggttggggaacttgagcgactttggctaatgaggagctctgtgccttgagcccccgaggccacagaatagtaaatattcagtctgtgcctccagccctgcagtgtgaggttccagtcctgtgggctccacacccatcacctgtattaggaggctcatgtctcaccctgtcttctggccagccttgaggacggagtctgagcctcaatcgtgcaacacccagggaggacagtggacctgttctctgtggtcatggcccagcagaggggaagggcagttcagtgagtgtagggaaaagaaagagagatcagactgttactgtgtctatgtagaaaggaaagacataagagactccattttgaaaaagacctatacttttaaaaatcactttgctgagatgttgttaatgtgtagctttgccccagccactttgacccaacctgaagctcacaaaaacatgtggtgtatgaaatcaaggtttaagggatctagggctgtgcaggacatgccttgtgaacaaaatgtttccaagcattatacttggtaaaagtcatcgccattctctcgtctcattaaaccaggggcacaatacactgtggaaagcggcagggacctctgcccttgacagtggtatattgtccaaggtttctccccatgtgatagtctgaaatgtggcctcgtgggatgagaaatacctgaccgtccccctcctgacacccgtaaggtctgtgctgaggtggattagtcaaagaggaaagcctcttgcagttgagagagaggaaggccgctgtctcctgcctgcccctgggaactgaatgtctcggtataaaacccgattgtacgtttgttcaattctgagatgggagaaaaacctccctatggtgggaggtgagacatgtttgcagcaatgctgcctttactccactgagatgtctgggtggagagaaacatcaatctggcttacgtacacgtccagtcatagtaccttcccttgaacttcattatgacatagattctattgctcacatgtttgttgctgaccttctccttattatcaccctgccctcctactacattcctttttgctaaaataataaaaacaataatcaataaaaactgagggaactcagaggctggtgccagtgcaggtccttggtgcactgagcaccggtcccctgggcccactgttgtttctctattctttgtctctgtgtcttatttcttttatcagtctctcatcccacccaactagaaatacccacaggtgtggaggggcaggccaccccttaaagtgagtgctgaggggcggtcaggaggcttgttttctttcctcctcatcaggacaaacaggagagtgcggtggacagatgggaggagatcaatgtgcaaactgtctgctcagcagactgtggagtttctgttcttctttgtggtggggtctcagaaatcttattcaaaatgttgctttcctcccccactggttgcctttttcacagacatctcacccatgatagcagggaatgagtccctctaaactattccctcagaacaacaaaaagatgatgaaggtgatgatgaggataaagaggatgatgacagacaccatggcatcatgaacccttactgagggcttcctaaaggccaagctctgagctctgtgctctatgcagcttgtttcatttcatctgcatagtctcccagttattagtgcacatttcatgataattttacagactagaaaaggagcaacgcattttcatagaactcgtaccagatcatgaagtcaaaaagggtgaagtccaatttgaaccaggcagtctaagtccagacacatggcatttggccagtcctctccctgcatccaacctgccctctcaaatccttgtcactcaggcggttgcccctgctcactgtgcccttccctttgggggttccttgtagaccacagctagaccagtgggtgccgcagtcactgtgtcaagtatggaaaggacagctgagatcacatcaaggattccagaaagaattggcacaggatcattcaagatgcatctctccgttgcccctgttcctggctttccttcaacttcctcaaaggggacatcatttcggagtttggcttccattcctactgaggaagctggaaagcatttcaaaaattctcctccgatgttcctgtggttaagacctctgagctctgcttaaaactttttgaagctgggcgcggtggctcacgcctgtaatcccagccctttgggaggctgaggcaggcgaatcacaaggtcaggagttcgggaccagcctggccaacatggtgaaaccctgtctctactaaaaatacaaaaaaaaaaaaaaaaaaaaaaaattagccaggcatggtggcgtatgcctgtaatcccagctactggggaggctgaggcaggagacttctttgaacccgggagacagaggttgcagtgaaccgagatcacaccactgcactccagcctgggtgacagagcaagactctgtctcaaaaaaataaataaataaaaattaagaaaaaaagtgcttggaagggcttggtaaactttagccattagctcacgtaccactttggaagggcagatcttcagtcacttcacccttgaatccctttgctcaagactaaagttctgagaggaagtctaatcggctgagttgtgtccatgtgggcagtgcaggaaaggatgcagcgggaggcggctccagggacgtctttggcttccatcgtggggaagcaggcgcctggattatccaccctaacaaatctggacaaaggaaaacgaggttctctcaggaaggagacatagagcccaaggagctcaccaagagataaatagtcatcctgtcttgtcattttcttttacacatgtgtgtacattatcttacagttatcactttgttttctttctctcctttaattgcaccctgctgccaaaagttaaaataacatgaaaatgttgagatagctcagtaactgacttttggtcaattgccttttcatatagtgaacagctgcccaaatagttgcctctgtcactgtgcaaatttgcaagtgtttgcatgatcactcccaatcccccaagacagggctgtgttacagcacaatttagttcagtgttttgctctccgcaacagggaggttctcatccattacaggttgcagtaaaaacaggggtaccataagcaaccaccgctttcctcaatgatgtgatgaaagcaaaagccaagtagcttgatgtatgcaacttaaaaatataaaaagttacgaccatgggttgcagttggagctatggcggcggcagctgccactggcactagcccggggtctggacctggggactccccagaagggcctgagggggaggctcacggagcgtcggtggaaggcgcacagaatggtaaagctttactaaggcctctcggaaggggaggcagcgggactccccgcggggcccgacctcctggaccgcactgatctgaacagggcgcacttcgacccggaagtttacctagacaagctgcatagagtgtgccctctggcccagctgatggacagtgagacggacatggtgcggcagatccgggctatagacagcgacatgcagaccctggtctatgagaactacgacaagttcaccccagccacggaaattgacaaacagcataaaactgtatgaggaattgcaggagacccagaatttcccaaataaccttgtaaaagaacaaagttggaagattcacacacacacacacacacacacacacacacacacacacactatatatatatatatataaaaataaagttttgttttcattcagttgtaaatatttagtaatttctattgtgatttttcctttaactcatgaaaggatatttttaattttccaaatgtatgcttgtgtttagctatcttcttgctgttgacttctaattttgttgcattatggtgaggaaattgtggtctggacaatgtcaatcgtatagtggattttgttgagacttctttaggggcctaatatgtggccagttttttttttttttttgcaaatgtgccacatatggttaaaaggaatgtggattatttgttttttaggggagtttttatttttaaatagataaggttctcagtgtaattgaaatctagcttcaattaacaatatgctagatctctcaaaccttaggatgttagtcaatgtaacactggacaatgctgctgagacaaataaaccctgaattctgagttggttggcacccatagcataatctggtgcagggcaggggttctccttgggggcccttgtccaacagtgattcagagatcttggaggtttccatgttttaattctgccatctcagagtttttcacttgtagccatatggataggaagagagggaacatagctcacacttgcctttggtaaccttggcccagaagtgatttcttcttttcctatttgtggaaatgcagtcacatggttccaaactaactgcaagtgaggctgggaaatgtagtctttctgcatgtccaggaagaggaatggtgtgaacgcagcattgtctttgacacactaagcatatgctgaagagttcttactctcataggaggtttgtctgtcctgtgtaactgtctcagtttttgcttagatagtttcaggcaatgttgtttggtgcattcagcttgatgattattatgtcctcttggcaaagtagtcaagattcccatcagtttgaatgaaagtgtcttacagagagggcaggaaatgttaatactttaaagggcccttctattcctccactgtacagataagaacaacagagtcctagagagaggaggtcatgggtctcactcatgagtggcagaattgaaaccaacatggcagtaactttgcctttcccccatcatgttgttctccgtctatcttcactctgctgatttcttcacttgctccatacagaccccccagtgccaagtatataaggagtgattaatctgagcttctccagaaagtccattcctggtaggcactgggaataagaaatctcagaatatgaaataacatcaaggggtagcacttttgtgaatggcttccaaattagttcctttacctttttcaggcttagcctgagatgaagcacatattacagaaatgttctctctatagcattacctattagtctaatgagcatgaaaaagaggagaggggacatgctctctctagctattattacctccactatagagttgacatacacaaactcattattgcattatgttttattcaacaaaataaatttaatgttgtagtttaaattaaattcgctgaaacatctttatctccagcataatgtgcctcaagtgccttcttggtgactgcattttctccagaattagagtactgaagctatgtaatggtgaaattatatgcaatctgcaaaacggtgtggctataacatcatatttggccttccacgtaattaaaggaacatttcctcctcagagcttttccatcagagacccaaaggctatcattgtacaaatcacccacttaggaaaacctttattcccagtagcctataaaaatctggttatgcaaacagatttgcttattcagtaacattaatagctcctcatggttaaaaagtcctataatctgtttcctctgtgaccaagtgtcgtttttattttgacatttgggagccttttgactcctttacagctggcaagaaggcacagggagggaactctcaaaaaccaacaacctatgtattcccagcctattaatcaatagaaaatcacttcaactggattagggtcttgtacctggcagaaaggctcttatggacattggaattggattttaacacttggtatggcaactccttgaatcagatcagattcgtgtttgatagactcttgccaaaaaattgctccaggttctgtgcagtagctaaagacttttcgttgttgttgttttaaaagcagcattaaatgttttcgtgaagaccttcccagcagtgattttattgtgaacatggtctttagctctggtcctgtataactcacactgaggaaacctctaacaagtgttttattggaagatgtctgatggatggttgcttttaataacaaatctcttccctttttctgtcccctgtgttctattctcctttctctacacgttattcagggaggattcacctattcccaaagtcctttcctctttatttccattccagagctctctgtataactccaggttgatgaatgcaactgcccactgtttatctccacttggctgtctgtcttgcattgatctcatcttaccttgcctctcctgatttcctcttcggcctgggctcgccacatcagatccacaccaccatccacccagcttccaaaacacctgggcctcctccttcattcctccctctttctcagtcaagttagtctactgtctcctctccatcctcactgccacagccttggtccagccaaccatcttgtctcacttggtgtattgcagcctcctacctggtctactcacctcccactctccttcagccagactgctcttcttctagcacaaagtggatcatgactcccctgcctaaaaacatctactgtctccctttgtctacaggataaacacgacaaagagcctttaagatttggctccaacttacctctacattagtcactttttacaattatatgaacatctctcagctcctcaccctctcacgtctcgatttttgcacatgctcttccctctgctgagaatgatcttccacacctctcctatcgacctggctagttcctaccattttctagtcttcaactgaggagtcctgtggtggagaaggatttctcaccacctgatagagattgcatgcccacccacctccgggcttttttttttttttttttttgacggactctcgctctggccacccaggctggaatgcagtgacgcgatcttggctcactgcaatctccgcctcccgggttcaagcaattctcccacctcagccttctgagtatctggaattgcaggtgaccaccaccacatctggctaatttttttgtatttttagtaaagacaggatttcactatgttggccaggttgttttcgaactcctggcctcaagtgatccacccaccttggcctcccaaagtgctgggattacagacatgaacaactgcacctggccgattgggtgccccttctatgtgctcccattgccccaggcatactgtcaccataactcttaccattctgagttgaaaatgattttttttttttgctttttatttctctcattaaatgcaaagctcattgaaaagaggacagtggttgttcactgttgtactcctaacctttgactcagtgtcctgaggttggctctagagctgtgcacacatgttcagacattggagcacatcttgtctagcacctcttttgaggtggcttagagaaaagtcagtaggtacttccccaaggatgaaacagaagcttcacctaaaccagttctgcaactgcagcctgcattagcattctctgagagcttgttaaaaatgcagtctcctagagcccactcttcaagagtcggtgagttgcttcatcatcaaaatatatacagaattcagccagtcttcagcgtcagcctggtctgagccactgtggactcccacctgcagaatgtccctgctggtctccttgcttctgctcttaccttctaattacccattcaagtagccagggtgatccttttaaaaattttttaaattttttttgagatgaagtctcactctgttgcccaggctggagtgcagtggtgctatctcagctcgctgcagctctacctcctgggctcaagccatcctcccacctcagcctcctgggtaactgggaccacagacatacaccaccacacccggctaatttttgtattttttgtaaagacacggtcttgctatgttgcccaggctagtcttgaacttctgtgtgcacccacctcagcctcctgcatttttaggaggcccctcttgtagggattttgatccagaggactgggtgcctcatgtctcctcccatctctctcttctttctgtctctgtcctctctctctttctctttgccttatagctgccctgggaactagactctgccttaggcatccctctgactcttgtttgcttttacactgaggctgttttaagttgcaccttgatctgaagccttgggcttctgttcctattccttgcttttgttggaagggccgtgcagcttcttgacaaattgcaaaggtgcctacgagtttccaagtccccaagaaccaagccagatgacaaacaaagatgcagcccacagctggggagacagatttcatgtccacacagagactccaagatgctgaactgaaatccaccccgaagcctgttttctctctcatttcagttcaatgtcagctgggggcttgcagggcagggctggtgaccattcacagggcaaagatgctttgaaatgtcaactgagaatggtgtggtggttgacagatggcacgacagaacatagattaacatggaaagagaaactcatcccttggggggagtgtgtgaggctggcagccacacagagggcttttgctgtgagctcttgcagagacataaacagccaggaggttttgctttctgagcctgagtggaagcatgttcctccctgcacattgccgctctgctgcaaatgtttattcccgttgcattgattaaaagtgcttaccaggccgggcgcggtggctcacgcctgtaatcccagcactttgggaggccgaggcaggcagatcacaaggtcaggagattgagaccatcctggctaacacggtgaaaccccatctctactaaaaatacaaaaaattagccgggcatggtggcgggcacctgtagtcccagctccttgggaggctgaggcaggagaatggcatgaacccaggaggcggggcttgcagtgagccgagattgtgccactgcactccagcctggatgacagagcaagactccgtctcaaaaaacgtgcttaccgaaggggtttgagggcagtggtgacagtgtgagttatggctctgctggctgccagtggagccagtcgctctgcgcagccgtgcaagggtgttttgaaaagtggctcagccggccaggagtgactgggtgtaaatattgctgccactacatactgtagcctgattggggccgtgtttgcagaacccctaaaccactacacttgttcaggcttaaaaataagcttacttttttggttgttttgttttgttttatgagatggagtcttgttctgtcaccgggttggaatgcagtggcatgatctcggcccactgcaacctctgcctcctgcgttgaagtgattctcctgcctcaggctcccgagtagctgggactacaggcctgtgccatcatggccagctaatttttgaatttttagtacagacggggcttcaccatgttggtcaggatggtgtgatctcttgacctcgtgatctgcctgccttggcttcccaaagtgctatgattacaggcgtgagccaccatgcctggtcaaacataaacttactttcttacctcttctgctgaactctatttgcttcttttctcaacttctgctgaactctattttgcttctttttcctggataaagctcttctttatccagaagacttttagcaacaaagttacccaatgcccttccctagtctctccttgcaactggctctcgggttggggtggggggggtgtgtaggaggaaatccttgacagaaccaatttacatgactgtttggagtactctggctagccccaggaggtgtttgcatttttaaattggttagtagtgtcagaatgtttcatgagtaagagcccagcctctaagttggataccctgaatttaaatctcaacatggccactttgtatataaccagaggttggatttggggacccaatggatctaccatgacatgaacttgcaccaacattcacctgacctccaaaatgcctattctgactagtagaccctagtctcaccctagtgccagttcagagcctgtgtccagtgatcctgcacaggtcccattagttccttttctcctattcagtcatcctggtaaaaggctgtgtattcccttgggcgcaggctgggagaaagatggacagtattaatttttggcagtgtagcagagtcctttctggagggaacctggcttcccattcagacaagtgactccgggtctgtgaactggctcacgtctgggaattgacgggagactgtgactctgtttttatgattcagattacacttctgctcacctgacctagaactcttctgcaaacacagatcaagtaaaaatgtggcaggcttcttatctctttcacttctaggaaagccacgatcagctggcaccataggtctctgcgagtcaggctattctggttgcagctttgactctgctgtcttttatggtaactgcatccaccttgcctttggggattgagtgctgtgaccacttggccccagcccttgtagtgtgcctatgtcatttaccctctttatatgtcagtctcctcctctataaaatgggaatcctcattgcacccacccccagggctgctgtgaggtatagatggattagcatttggaaagtaatagaagagggtctcaaagcccatgtgtcgttatcagaattatttcgtgacaggggagagctggaggagagaggaaagagttgagcagacccacgtgctctcccaccagtgtttcctgagcacctactatgtgctgcccactgtgagagctgttagggttgaaatagggagcacagcagtgtaggggctgccatcaggagctcagtggggagaccattgtgcaacatggttccagcgcttgcggtggggaagctcagggagtacaggggcctaggatcctgggcagaatcatggaaaggacacagcctccccagcctgtcctgcctccgctgcctccctggcctcctctgcatccctggcctctcctgacttcctggcttccccttactccctggcctcctctgcatccctggcctctcctgacttcctggcttccccttcctccctggcctccccagtctcccctgtctctcctgcttttgagatgggccaggagctgctggtgctcacttagcctgtcctggactctgggtgtagcacttcgatgtccagaaaatacgcccgggttcagctcatcacacagccaaggaaggagctccacactgacactaagggtgcatcctgggctcattcatcagggcatgcctccaaaatatttctccacgtctcctccctttgcccacctgcactgtctctgtgcctgagccctggctgagggtctgcaaggatcccctatctcctctgcccctgcacggctgggtcccaggcaatctgtccgcccaccacgcctgtcgccccttgcccaccacgctccagccccacagtcctctttctgcttctttcccagcctctgggcttttgcacacgctgttccctctgcctgaacaccctccactgggctgagaacaactctctgagacctctctcagctgttgcttcctttggaacagccgctgctgctgtccctctcccagctgcaagaccggctgagcctcctgtctttttcagttcccatgcccccagcacttctccttggcctcctttggccgaattgacaatgtccattctcaatgccttctcacccagcgctgagccccactggatgaaggcaatgcctgtcatgttcaccgcaatatcccctcccccatcaccacgcctggtccacagtgatgctcaaaaaagatctgttggtaggcaatgcgaaggtgcattcatgtcatcctgcaggcggaattctccacgagttttgagcagcctcgggtttcccaccccctccaaatcatggaagaaacagggtaagagcaaagacaaggtggctgtggccgatatccaccctatccgggcgtcccttgtcttctctcctccttgggcagggagactatcggggtgcaacctggctggggcggggaggaggtgcagggcctggccagagcgggcctggccacgggcaagggacagcgaccgcctgggccaggacaggtgagagcggcgcagtcccgggcccggcgtgtccgcgctgcgcgggagaggccagcagagggcgccagagagccaggagcggcccgcggaggagcccgcgccagccggatgcccagctccgcgccgcgcggacccaacgagcccgcgctcagacgccccagctccgccgagaggccgctcgcgccgggtgcttcttcttcccaagtgcaggcagagcccctggagccatggccagcccttccggcagctccgaagccactggcaagccccgaggcagggatggccggcccaggagggaggaggacgacgtccctcccgaagagaagaggctacggctgttgctggaggggggaagcgcacagcccgaggactgcgaggacggggaggacgcgctgcggccgggcagggaggagaccggcacctagacaggtggcgacggcagaggagtaagtgacgcgggcgcgggggtccggggctgccgggggcgcggaggtgccggggacgcggggtagaggcggcgggaggctccgtggccggtcccgggttgaagttggtaattgagcggcaagtccggcgggcgcggagtgacagctcgtgacggcctccgagacgccagctgccccttctcggctgtgtggcttcgacttcctgattctcccacgaggtccctggctgggatacccgctggactctgtggctggccaaaaggggaggggcagccccgtgtcctgggggcccccagcaggggaagtggcgggtgttgcgctgggcatcctgtctgggacatctgtctgggagtctgtcggtgcctctcacctggcgaggggcatgtggtgggggcaggggggaagtccctggcgccaggcttggccaagccctgctctgctgggctgcgggctggtggcgctcacccagctcctcacctgtcccgcatcttcctgtttttttttccctttctagttgggcagccagagttgagaggaggcagatggcttccatcccagaaattgttctctttccatccctacagagagggacagagaggcaaagttccttgcatcccccggggcgctgtccctatgagctcccggtgtcctgcacacgtgggcccctgagtcaccgggcctgtgtgtgtgggatggggctccgtggccagcctggcctcctggggttcactttctgctttcctaccccaactcttcctgtgtggctttgctggccttccactggggaggcacgtgagtttggagggcagatgaaggcctgctggagagctgtacccctcagtgagtgctgcccccttgatggtttttgatggataatggggttgacctctttgttccttccacatgtttttatgtttgaccatttacttaactgagcttgtcttaataattggattcgtggttaatgagccccacatgggagagagggcggcctgcattctgaacccatttaggcagcacgggcagccctcctcgccgtgggctgcatcagagcccccctgcccagtcttggggttgctcctggatgctgtctgggaggcttgctcatggtgacatcctcatctccctgtgcacgttaccgcattcagagcttgggtcacctggacactgaactcaggtgaattttctctgagatcccgggagaaggaggacagttctctggaaggttttccagggccgatcacggaaaggatgagaagggagaggtactggtcgggaacacaattacggtggcagtgtaacaccacgaaactttattgcgtaaagtccctgtcactccctctacctccttcttttacgtggactctgccaaagaccaggataccataatgcagtagggtgaccaagcgtagtgggaccttgggaacaggagtctggagccaggcggctggggtttggatcctggttctgcccctccttcgctggctgacatggcacaagccacttaccctctatgagccttactgtcttcagtggcaaatggatctgtctagagaccccagtgcctgcggttgttactgctgagattaagggaaactcgtccatagaagcacttagcgttgtgcctggcacatagtgtatggcggataaatgggacttaggactgaaactcatgccttagtgtgtttttgcagtgatgttttgttctggggtgcatcacaagagacaaggtccttggcctggcgtggtggctcaagccaataatcccagcactttgagagggtgaaggggggatcgcttgagcccagcagtttaagacgagcctgggcaacgtggtgaagcctcatatctaccaaaaaaacaaaaacaaaaacaaaacaaaacaaaagccaagtatggtggtgtgtgcctgtagtcccaaggactttggaggtggaggtgggaggattgctagagcctggaaggtcgggctgcagtgagctgtgatcatgccactgcactccagcctgggtgacaaagtgagatcctgtttcaaggaaaagacagagagagagagagagagacagacagacccacaagagtcttaagccagaatcttcatgttaaaatgctttctggaggctaaaaggatgatatgttgataatgaaatatttaaaagacagaaaccccactgaattgtttggtccacagagggtaatgggaatcgcatgacctgaagcatgatggaggaactgaatagaaaccatccttgtttcctgaatctgaacatggtaccctcttttcacggtgtctgtatctgctcagtccagcggcccctcgaaaagagggaatcttgattttcaaacttaaaatttggcccaaagcccactgctgcccacaatgcccgccagacacattcctcttcctttttagtttctatgggaatactctttctgaagaacccatgaagcagtgtcaggctggtacgaggatcagcagtgatttctttgaggaggagagcccgtttcttcactcacaggccacgtctgagtggatcaagaagaacagagtgcccttttatgagattttgtctgcgtagaccactagcttggtaaaaatgtcaaaaccatcctcgttccttaatagcagattattttggacttttctctgtaagaagcagcatgggcattcagatgcttttaagggtaaaatgttctttctcatcaccaggcctggtgctcaggatggctgaggttttaatgtgacttggtgtcccttggagtggctcccagggtgtgatcttgtggttgggtggcaaggggttgctttattcgatggtgtctagaggatgttttagtagataaatcgggaccccaggagcccctgtgttgcaagtcctgctgcagggcatgtgtttatagtggggatgtgggggggtggagggtggggggcattgatttcctgccaatatcagaagtttcacaggcttcttgtgtatccacaaacaccgaccccattgagaaggcctagaaaacctggccctccccaagcctttattgacaacttgtgaatgatcccagggtgtgtctgacccacagctcctcctggagggagagaaaagtctctcctagatatttggttatcaacctcaaccacttgctgagccttccccaagaccaggcatcttgtcagagacttctgggttgtcaggcagaaccgagcattcaagggtaataactcactggagtccctgaaatccttgatggacgcaccagttgaaagcatccagggttgaaaccagatcaggaaggttattctcagcttggggctcctgcagagggcttcctgcagaggtgcatccacgttgcagggatttcccttcctgctgaggagaaacctgggtttctcagctttggcacagtcacaacatttggggtcagatcattcatggtggtggtggtgggggggggctgtcctgtgtattgtaagatggttagcagcatctgtggtctccatcctctaggtaccattctaccctcccagttatggctaccccagatgtctccagacggtttcaaatgccgtggagcaagggagttgtatgtgagccaaaccactccagttgacagccattggtctacacttgtggaaatgtttgagggtgagagtgtcaagcttgggtccctgctgtactctttatcagcaacgcagtcttggaaaattaatacaactccaggggcctcagttttctcatctataaaatggagataaatgagatacactttcataggaaggttacatgggatttactgagataataagacagtacattgaaaatgctgggcatagcatttatttatctttattttttttttaagatggagtcttactctgttgcccagcctggagtgcagtggcatgatctccgctcactgcaacctccacctcctgggctcaagtgattctcgtgcctcagcctcccaagtagctgggagtacagttgcccaccaccacacctggctaatttttgtatttttagtagagatggagtttcaccatgttggccaggctggtctcaatctcctgacctaaggtgatccacccagctcggcctcccaaggtgctgagatcacatgtgtgagccaccaccctgggctgggcatagcattgtaacacagacaaagcacaaaatacttgggcaatatgtttctacatttgggttgtctagactccatcctccatcccctcatgtactggtgtggtgcagagcagaatatcacccacctagactgcagagtggatttgggtggcatcttggctttctgcacaagacttgcctgttccccaccatgtacccctggttctcagggtccaggattccaggaagcagggatgtggacaggcagggcaggtggcccacccagttcactcccacgctggggacctgcagagccagctccctgagacagggtgtttggaccaacatctgggtttctggatttccatttgagcacagctggactacacaggctgaagctctctctgccgagatatagatatttccctggtgacgatctttcaagctgacatgaagacatggccacctgctggaacgtgttgtgtctgctgtggcgctcttgtaatttgtggggtaggctcctgaggaatgcagtgtgtaagtgggaaatggtgggaagttctcgcatcctcccctggccaaaagtgctgcctgcacaggttggtggatggtcctttgagcaggaagaagacatgaagccattcctgttagctacgacagagaggggcagggtacacactggacatttcgagcccatccagagaagcaagtcttactatgctgggagtactttggaatgggggctgtgttgccctgggctttaattatttcaggaacatttaaccacagggctggcaggctggatcttgatatgtgtttctcagttggaaagactttggaccatagggagatgtcttctcaattcttttaatttcattatggttgtcatttttcttctcgtggcctctggattgtgacacagaactcaagggacaggagggagatgagttggaggctgggacaggggtccctgccagggatgctggtgactcacatgacggtactgatgtgtggagtccggtgcctggtttggggaatgttcgtgggatatgttccaaaggactggcagacctatcaggtactggaggtgaatggtcaggtctgatctcagggctggcagtgtcaggcaaggacaggaagttgacgttggactcattggctgaggttgcttgggacccagggggcaatgtgtgccaggacagatgggtctggggctagaaaggcagatttgggctggatactcgggcttgggaggcatcccaggtagatagtggttgaggctgtggaaatgaccgcaattgcctgggatgagcatggagacagacaagatgggggttttgctttaagcctggggagcccacctcccaggttcaagcgattctcctgcctcagcctcccaagtagctgggaatgcaggtgtgcaccaccatgcctgagtaacttttgtatttttagtagagatgaggtttagccaggctggtctcaaactcctgatttcaagtgatcggcccaccttggcctcccaaagtgctgggactacagacatgagccaccatgcctgaccatttttaaatattaattgttatgaaatattttcaagcacattttactatacattggaaaagtcaatcatgatttgaaaacttcatcaaaatccaatcaaatctcaattaaccatttaattgtggataggtaaggagactattttgaccaaaacatattagaacaattaacacttatagatataatctatgttttaatgttttagttgaattaaaccatcttttatattctggccgggcacagtggcttacagttgtaatcccagcactttgggaggccgaggctggcggatcacccaagatcagtagttcgagagcagcctggtcaacatggcgaaactgtctctacttaaaatacagaaattagccaggcatgatggcacacacctgtaatcccagctacttgggaagctgaggcaggagaatcatttgaacctgggagacagaggttgcagtcagccgagatcgcaccactacacttcagccagcctgggtgacagagcgagactctgtttcaaaaataaataaatacaatagaattctgaattttatttttaataattatttttgtaaagagaatgtcttgttttttggagttgttgaatttattgaattggcaacaattatgtacaaaagggtatacaacatgatgtgattgaagtatgtatacattatgaaatggctaaatcaaggtaaataacatatcacctcccagacttatttttttgtggtgagaacacttaaaaaatctactctcttagtgattcccaagtgtatgatatgttgttattaactataggtaccatgttgtcccacggatctcctgaatttattcttctctaaaaatgacattctgtgtcctttggcatctgcccacttccccactctggcaaccatcattctactccgcttctatgaattcaactttttttttttctttttctttcttttttttgagacagtctccttctattgcccaggctgtagtgcaggggtgtgatcttggctcactgcagccttgacgtcccaagttcaatcaatcctcccacctcagcctcctgagtatctgggagtacaggcatgcactaccatgctccaataatttttgtattttttgtagagatgggctattgctatgttatgcaggctggtctcgaactcctgtgctcaagcaatctgccggcctcaacctccaaagtgctgggattacaggcatgagccaccatgcctggctgagttcaacttttttagattccacatgtaagtgagataatgtggtatttgttgttctgtgcctggcttatttcacttaacataatatcctccaggctcatccatgttgtctcaaatggcaggatttccttctttttgaaggctgaatagtattccattgtgtatatacaccacattgttgctggaagtttaatggaggccagttgggggaggagggggagaagattcactctaagtctagatgctccagcacccacccaggatgtgtgcaaggaagtgcaggatgctcctggtcttgcaaactgtggtttgtgggactccaaagcccctatccttccacgatgctttctgtcctgttatcacatttccttggaggagaaccccgccttggtggagagccctgctctggctttgtccctcggcatgagatggcaaaggatggtgccgctgggagaccctcacgtctgcatactgggggctgtttgccttctccattcctccttcaagtatctgagcagctcctgtgtgccagctgctggtctacaagacggatcggtccttggagatcacgctgtagcagaggaggcaggctgtagcccacaggccagaaccagctccctgcctgttcatacatataaagttttattggaacacagccacacccatttcagtgcatattgtctgtggctgctttcctgctacaatggagagttgaatagttgggacagagacctatggcctgcaaagctgaactatttaccatctggctctcaagaaaaaggaaaaaaaatgcttatctttgtaccccgacagtcttagattaagaggactttgtaccaccctgacgtcccaggcggccatgagtccagccacccctgaaatgtacacaagtctgggctagggttgcagcagatgagtcccaattttgcagatctttggtatcaggggcacaacccaggattttgagtggggtttcctcatcactgtggctgggcactgggctagtgtgctttctgatttttgtatggggaagagaaaggagggaggaaatggcaacttgttgccctgttctaacgttttcctaggatgggtctccaggcaagggcttgggatctcaccttgcacagcttacaaaacccagtgaggccggctgtcttggcgctgccactctgagggatggagtccccaaatgactaggaagggagataaaagaatggtttctgcaagcacaagaagtggcgttattgaaattaacatttcccccaagttttacaatgtctaggcatgcatatttaagtgtctgcctcaaaagcttttgctaataaccagatggtgcatttaatttcctttttttgttctctgagcaacttgcagcttcctgcacagccctacttgcaggcaactgcactgaggtgacagtcctcctgactgccagcacagatccccagggcctctgagggccctgtattctggggtcagcctttcccccttctatttggccccagctggaggggggcagattacccacatcccagcacagggctcctgccttagcttctctagggagtctggctccctctgaccctctagacctcaccagctgaggatcagagccccagggcaggagccagggccagagggcattgggggtggtttgagagtgcagctctggaggggggcagtgcggaccaaggaaaagctgctcaggggagactgcaaagagatggcagagttagaacaagagggccaggcatggtggctcacacctgtaatcccagcacttcgggaggccgaggtgggcggatcacctgaggccaggagtttgagactagcctggcctacatggtgaaaacctgtctctcctaaaaatacaataattagccagacatggtgacacctattataccagctactcgggaagctgagccacgagaattgcttgaacccggaaggcggaggttgcagtgagctgagattatgccactgtactccagcctgggcaacagagcaagattccatctcaaaaaaaaaaaaaaaaaaaggacaaaaggaggagggcagagaagggagctgtggggcagcaacaaggaccttaaaggcacagaagaggaagcttggatttccaattccaaaggacatgaagacaaagtcgcacacctttatttaacctgttccaggtgaggctgggctttgtgtattttccttgttttccttttccttgtgttcaggctgttgtaaaaagaggtacacaggggctctgtgtggtgccctgttctggtggccttcaggaagcatggggtgccctggtttccttggcttcgtgtccccctttcctcctgctacccctgactgtgcacccgaccttatccctcagaccatcctcctaaaggggcctggccagggctagtgtccttgctagtctctaggaaggaagactctgtggcttgaaagcttgttggcttaagttgcaaggtgtaggtgcctgggagggcatgtgcatggccctttgactgatccattcatgtttttcttttttgactctgttctatgttgtcctgatggaggggtaagcccctgccttctgcctttcctgccttggactcttgcaattggaccagatgagagggtccatgtggtctgagaattcaagcaatgcaggccaggcatggtggctcacacctgttatctcagcacttttggaggccaaggcgggtgggccaggagtttgagaccagcttggccaaaatagtgaaacgctgtctctacaaaaaatacaaaagttagccgggcttgatggtgcgcacctgtaatcctagttatttgggaggctgaggcaagagaatcactggaacccagaaggagcaagttgcagtgaggagcaggttgcagtgaggaggaagttgcggtgaggaggaggttgcagtgaggaggaggttgcagtgagccgagattgtgtccctggactccagactgggcaatagagcgagtctatgtttccaaatatatatatatatatatatatatataaaaaacaaaaaactgaacatcctcttgatttgcttttcttggtcctgcttctcagaggtaacactgggaagggttggggtatacctctccacacctttttctttgatttccttttattttttattctatgttttgcagaatgtgcaggtttgttacatagatatacatgtgtcatggtggtttgctgcacctatcaacccgtcatctaggttttaagccctgcatgcattaggtatttgtcctaacgctctccctccccttgtcccccacccccgacgggccccggtgtgtgatgttcccctccctgtgtccatgtgttctcattgtttaactcccacttatgagtgagaacccgcagagtttggttttctgttcctgtccacacctttttcctctgtgcacacaagcacatgtatttgcatataagtgtttattgtaacttttttaaaaagtaaaaatggaataatgccgtatttattctttggaaagcctgcttttcaggcagcatgtctttgacattgtctcacgttggaacctgggtaccaccttcttctcccagcagttattctgacgtgtggatgcaccttgcttcatttaaccagccctgcaccgatacgtctttggatggtttccgccttttcccaatcacagacggtgttctgatgaatttccttacacacatcacttggtgctctgtgcctgcatttctgtgagatgttcctggaggtgggctgtctaggtcagagggggatctgtgcttaatttgcatcctgtgcaaaattccatccagtcatccggctccccaagggctcacatggtactgtcctctgtagacatcatcttctgcagatgatggcacgaccgcctctctttcttttactcacaccagtctgcatcctggtgtcctgggggttccagcccctacgtgcttgtctgccctcaccccacagtccccccagcccctgctaacaggtattcaggcttctgagctgtggcagactgcctcactctggagaagtttgctttctcaaacattcctggcaatgttactgcaattctcgaggcctgcatttgccgccttcaggcctcagtttcctcaaaagtaaaatgggaataatgtgatgctactgtctgcatcctagagctgccatgagggttcagtgagatcactgttgagagcacgttcacagcgccggccttgtgcgcagtcagcacgtgtggggcagggctgttgctgatacgtggttgactgtcattgctagactgtggctttaccaggggcattgtctttagtgccgagcccagagccacctctagtacctgctgtgtttatagagtgattgagtgtcagggtcagagactggggcaatggcagcagaaacagaggaaagaagtggggcttctaataggtcctgcaccagtggcccttgagatgaagccttcttgccaaggtctggggctgtgctgtgtgttctaggcccgagactggaagctaggcctggctgcagccccggcttagctggggaagtgcatgtcagcatcctgcttcattaggacacctccaagtccagcttagacctggatgccaggtgaccctctgtttactctgagcccagacagaggacagggaaatgtgcaagggtggggaccctcatcacagcccttgactctgtaaggcatatgggtttgtgcacgtgtgtgagcacggccgtggcttttctgtgagtttcaaggtcgaggttgtgtttatgcagggttaggcttgccaggtaacatacaggaggtccaattaaacctgaatttctcattaaccttttttttttttttttttttttttttttgtgcaaatatatcccatgcaatatttgggacctgcttaccctaaaaaatgatttgttgtttatctgaaattcaagttaaactggcatcctgtcttttcacttgctacgtatgagagttccgtgtgggggttatcagtgtgcatttgtgagttcccatgtgaaggactctctccaagtgtctgtaggtgccaggatggagatggacagagaaggtcctcttgggctgctttagtggcacctagaggctctggggttggacacttcagcccaggggcctaggcagcactgcccagcacctgtgtgctcctgtcttcttcatgggggctgacttccctgccatctctctccaaatacggtggcaagagctatcccatccgcccccatctggagctcagctgcccagccagacaagatggcaaacagtgtgcagatggctgcaaagctttccccagctctttctgcaaggggcctacagatgaaatggaagccctcatcctcaccgcctcccccttccagaaaacctaggcaacagccacctctgaatgctgctttagaagcttctccctgctggtgattaaaccaccacaaacaaataaagcactgcatttccaccataggcttgttcacatgcacgcagccaattgtcttgtatcagcctgtgtgcctgattcatcagggtgaggggttctcctctgaggtgcttgcaaagagctgcttgcaaagagctgcttaattttcatctgaaagggctttggaagaaagccctttctccccctttagcaaattctgtgtcattatttttttttttctttctttttgagacggagtttcacttttgctgcccaggctggagtgcaatagtgcaatctcggttcactgcagtctctgcctcccgggttcaagcgattctcctgtctcagccttctgagtagctgggactacaggcacccacaaccatacctggctaatttttttgtatttttagtagagagggagtttcaccatgttggccaggctggtctcgaactcctgacctcaggtgatctacctcggcctcccaaagtgctgggattacagatgtgagccaccatgcctggccggaattctgtgtcattctggatacttatcgtgacttcaagcatccaggactctgtcctgggtatcctgagcctgaggctgtatgtgtgtccagctggcttggaggttgtctacaggcaggttgaacttggcctctgagtccatggcagcctcacatgggaaataccaccaaggagtttcatcctgtgcttttaggagatagtttctatttagtcattgctgaatctgttacagacagtgtctcagtttcttgcaagtcctctatgaggtgcgtgctgtgattatccacatgttcacttgttctttctggcctctttcaggctcttgcacttcctttgctcttttcctgccacggggcctttgcacatcctgctttttctgcctggaacgattttccctctccctacctgttcacctggtcatggtctcatctgacagtggagtcactacatcctcagggacacctggccgccacactgactcagtcacagcaaccccctgttaactgctttcatgacaccagatgtcatgagctcagctatggcttcctatttctgtgcgtgtcatccttccccttcaagactgtggtcaccatgagggccagggccatgcctgttcctgattctcatttgtgtctctggtgtttagtatatgctcacctagaatttgattaatgaatgatggcatagccattttacagatgagaaagttgaggctcagggacattatgtaacttgctcggtattagatagtgatggtttgaagccatctggctggtcgctgggtgcacactcttaaccacttcactatggttcttctgtcatggtagttctccaacagcaggagtgagagacaactttaggacaggtgtaaccagaatcccaggggttatcctagaaggtggtgtcaggaacatgcttgcctatgggccttcttactgtattgcataaaataccccgtttttctgactcgcctttagtaaagaccttagcaatatttgaagcacagttgtcagtaagaaagggtgggtgtttatacttttttaaaaaggagtctatatcatatttatcttgtggtctgccatgccccctgatcttccacagcttcagttatgcaaaattaacacttcttctcttgactgcctctctcttacctgttcagtttcttttctgtgttcgagattgcttagaatttttccccattactacagcctgcttcccacctgtatctcccagccaacttgttctggattttgtcaacaacagttccagcgtttagtgagggctggactgaaggaaagccttggaaaaggctgtgtgatgaatggtgaagacacttaatgggcagacagtcatcagggttaattcaaaggctggaagaagggctgacctggaggactggaaatgtctttgagctgaaggtcatgtgcaggtggaacgaagagggtgagccttttggggtgaactgcaagcatttgataagatccctgtccccatggttggggaagtcttgataagcaacctcaatgggatggagggatcaaggaacccgtgactcaacctgtccagcatggcagcaacatgacacagccaagttattgattattggttgctcagctgtcatcactcaacatcttctgttagttatagctgtaatttgcattagttgtcagtgccagttttgactttcctagtcaataaagtgttctgagagtggcgactaaggctgagcactacccataatcatgagtattacagaggcaagccgccttgcccacacacctgcaggtgatgacacaccctaggaaatcactcaattctttggaggaccctgaataaatgctcaagtccatttgttcatctgtccatccatccatccaccattccatccatccatgcatccatccatgcatccatccatgcatccatccatccatccatccatccatccatccatccatccatccagacacgcatacatccatccacacacctacctatctgtccacccacccacccatctatccatccaacccactctcttatgcacgcagctatcatccacctacccacccaccaacccatctatccatccactcacccatgactctatccacctattcactcatctacccatctatccacccaccggtccatccatttatctatccctccaccccctcacccactcatccatttctccacccactcagccatcccttcaccgagtcaaccatccattcattcatccatctgcccacccacccatctttccatccacccatctatccacctacccacctacgtatccatccactgcttgtccttctgttcatttattccacaaagactcattaaccacctactagattctggggaggtatctgttctagtaattgagaacatggtttctggaatctgattccctgggctcaaattgagctgcctcctagctagctgcttgggtaagttatagaaactgtgctttgattttcttatctgaaaattggctattaatagcttctactcttgcagatatagtgaggattaaataagatgacacattaaaagtgcatcatcgacactcaatagagattaggttttgccattcattattattcttggcagatgctgcagataacgtggagagcatatgaaagacacaatgtttgaaccagtagtgacatacaggtgctaagttctgcagtaggggaagggcagagagccatggagagggcgtggcccaatcttggagcgtcagaaaaaagttccccgttgaattgctgttttagctgagacttgtgggatgggtagtagttggagatcccagacaggaggtgaccgagttagccagggaaaaattgggtcctggcacccatggcagagttgagtgatccagtccttctgtctcctctggctggaagtccaccagatctgggaatgtccagctggggcagtgggctgacaatgatcatgaccttcacctgtcctcacatgtcctctgtgtatctgcaaagcctctgcctcagtctcctcttctggaaagtgggattgaaaaccacatctgcttctctcccaggactgctaggaagacaagattagatggcaggtgagagctccttgaaaatgaaaacattctgctatttgaatgcaaagtgttcttctttgcctgtgatgtttcctaatctgtgaaatcatactggacctcgaaggtgtgtattaaaaaaaaatagcaaagtggctgggcatggtggctcatgcctgtaatcctagcactttgagtggctgtggggggtggatcacttgaggccaggagttcgataccagcctggccaatatgtgaaaccccatctctactaaaaatacaaaaattagccaggtgttgtggcgtctacctgtagtcccagctactcggaaggctgaggcacaagaatcatttgaactcaggaggcagaggttgcagtgagccgagatggcaccactacactccagcctgggcgacagagcgaggctctgtctgaaaacagaaaaaaaaaaaaaaaaaaaaaaaaaaagcaaagttaacacttcctccatctctcccctaggggaggcaatttgtcaaatattgttgttggattttacacacagggaaatctaaggaagggtggaaaccagatcaggaatccagactctcatctctctgtttacagggtcttaaatgggggagccactttgggttcttaccacaagattgctttgtaaaaaaaacaagaaacaaacaaacaaacaaaatgctcaaaaaaacagccctgacctaaatattcacaagggaccttaggcaatatctgcaaacaaaagtgagtgatgagtggaatctgtcgtctttacaactaagacagctccagagttgaagcaagtggaaacatctctagagacagagatttgggcgggttttgccagttaaaagctatgagaacctgggcaggtttacctctctgagcttctgtgaccttgtaaaataggctgcattgcgctaaatgtgcaggaggaatcccagcatcctcctgtgcacaaggctggtttcttcccatccttttccttgttctgcctctctcctcctctccaagagacgaatacatttgggcccagtagggacctatgtttgcaaaagctcgcaggcgattctcatgcagacagcctggctctggcactgagttcttggacacttctggaggcacatttactagtgaggaagatcactgtgtgctgaaggcatgactcatcttccattcctttcttccataaagcaaggcgcatgggtcgactgagctgggagagtccacggtgtcagcctcccccacgcttccctccctccttattccttgtgtgctgtactttgtcttgatttcctgtactctgcaccaagccaggagatggtaagctctcaaaaaaatcatttttttgggaaatgggatcaagagggttttggtttgcttgtttgtttgtttgagacagggtctgtcgcccaggctggagtgcagtgtcatgaccttgctcactgcagccttgaccttctgggctcaggtgatcctccctcctcagcctcctgagtagctgggactgcaggtgcacaccaccatgcctgactgatttgtctatttttttgtagagatgaggattcaccatgttgcctaggctggtctcaaactcctgggctcaagcagtcctccatccaccttggcctcccaaagtgctgagattacaggcatgagcttctctgcctggccaaggtttattattattattattatgaaaaattgtcaatatacataaaagtagagagaccagttgaatgagctatcatatacccatcacataggtttaaaaactattaacatttgcaatatttactctatttgtttttctgaagtatttaaaaaatagttcacagtagttatgtaattgcatcctgatattcacccctacgtaatttactttccctctaaaaacatgagggcattttttatatgatcattgtcatacctaatcaaattaccaataattccttaatatcctctaagatcaagtttacattcagatgtcttgtcctcaaaatgtcaattgtgattatttttttctttgagcaaagataataagatctcaagatttaatgacagagattccatgttagccctgatgtctaagctctgtggtccattgtggctttacttgaaagtctcaggcgaggcgtggtggctcacacctgtaatcccagcactttgggaagccaagataggtggatcatgaggtcaagagatcaagaccatcctgaccaacatggtgaaaccctgtctctattaaaaatacaaaaattagccaggcgtggtggcgggtgcctatagtcgcagctactcaggaggctgaggcagaagaatcgcttgaacccgggaggcggaagttgcagtgagctgagattgcaccactgcatgccagcctgtgtggcaagaatgagactctggaaaaaaaaaaggtctctcaccgtggtctcataataaaaggacactccatttcccatctggcccctgctccttaatattagccccctgctgtggggagaagggggtgaccttcatcgcaggttcaagcattcccagggctggctctgatcccgataaagcccatcatgaatgaatgcctcccttgcaggttattctaagtattgtaaatagtgcacgtggagcaccctcatgatgcctgggatggtagtgaatatttataggtttcttttagtgccttttttttttagtgttttccatagttccatgtttctacaacccttaggaacatcagaatcatgtgtgtgtgggtgcttattaaatacaccaattcctggagctcactcccagtgactcccagtctgatgattaggggctcagctaggacctatgtttgcaaaagctcccaggtgatctcatgcagccagcctgtctctggctctggctctggctctgggagctgggttgggaactagtctttggtgctattctgctgaaacttcaagttgggctctttgactccgtcttgtattgtcaccccttgtattcagatctgtttttcccctgtattgtaaattccttgatgtctgggtcatctcagctcatgagctgagctttcagtgggtgctcagtggaacaggtgctgagtggagtcaggctctagggaggccagcgtgtgctggtaagtgagagacaaaaatcattttaaaaagaatctttttgcccttcagttgtgtttaccatgagttaatgtgacttactctagtggaagccagtgcagcttaagtggaagtcttgccctgaaatggagcaaggttatggatcagcaaagctgccaaaagcattttgggggaattgtttctgtgtcaccctcagttgattgaactcaagttttcactcccttttaacaccacgtgggggccattctgacttctgcggagtgggtatgatcaggtcttctgtaaaagtgtcagtgaggaggctgggcacggtggctcacatctgtaatcttagcacttggaaggctgaggtggtcagatcacttgaggccaggagtttgagaccagcctggccaacgtggtgaaaccctgtctgtactaaaaatacaaaaattagccaggcatgatggcgcatgcctgtaatcccagctactcaggaggctgaggcaggagaatcgcttgaacctgggaggtggaggttgcagtgagctgaggttgcaccactgcactgaactccagcctgggtgacagagcatgactctgtctcaaaaaaaaaaaaaaaaaaaagtgtatgtgaggaaactgggatagagcttggggatattgggggatggagatacttcatctactgaacaaaaaccatgggataccaatgctggaggaagaagcatcatcctcagtttctactaactcaaccacgcatgagatggggacttggtgtccaagagcagagcctctttttaggtcttcagccttgatcaaaccatttctgaattcctcatacacatataatcaggtactatgagtgctactgattggataatctttctgtcgtttcctgtgctaggaaggaaaatgcatgtacagctaacttccttgagggttcgttcttttgcatcagggtgtctcaagctcctgctcttaaaacacctgcaagagaatcatccaggcggcttgctcgctctgtatgcagaccctttagaatcagaatcagaatccctggggctggagccacaaaatgaaatgacatttcaacaagtttgtcatcacgtaagagagaataggtgagtatttggatacctataatacaaagtagattcaaaaagaataatgattattttaaatgttatgtttttaaaaatttaatacagaaaaggctgggaacggtggctcacgcctgtaatcctagctctttgggaggccaaggcgggtggatcatttgagatcaggagttcaagaccagcctggccaacaaggtgaaaccccacctctactaaaaatataaaaattagccaggcggtagtggtgcgcgcctgtaatcccagctacaggggaggctgaggcaggagaattgcttaagcctgggaggcgaaggtttggtgagctgagatcgtaccactgcactccaatgtaggtgacaattgtttaaccaccaccaaaatggtttctgagtccaaatattaatatgaaggacattggtgacattgtctcaaaaaattaatacagaaaagtacaaaaagggagagaaatcaccccaaatctcacgaccccaagaaataaacctcctaatattaagtgaacaacattccttgctatgcacaaagatggctagagacatgaacagacacttctgatagcacaaaatcagattttaaaaagaagtagcaaattgaatgctgtgtaaatttatcagaagaaaaagaaatggaagtgaaactgaaggaactggtcaactcagataaatgtagtttttcctcactaaaaatcagtttctagaacgtcaaagaaatcaaagatgatgaaaactattaagatgttttatatatatgtagaagtctttacagtttattaatcatctcatgaaaaatttgtacagtcactgcaaataaagtcattgcaaaatctttactccttttgctttttgccagcactgacattggcctttgcagtctcttgacttctttctgcccttgcattcctgttgctgttttcttgaggtcatcttcttctcatgccagctgtgtcttgcaagtctatgtttgagttcatttttctttgcataattcaaagaaccagatagcatgccaaagcccattgtttaaccaccaccaacatgggttctgagtccaactattaatatgaagatgacacatattgtggtcttgtacattttgttgtctttccggggtgaaggacattggtgaccatttgtttcctctggagtggtcgattggtcatgaacttcctggtccagatagttactgtgccattcatgatggtggttgatcctcaggtagttagggaggaaaataaacaagaagttatatatttaaaaccacgtttcaattttagacctgattaattaacttaataaagggcattaacacttctacttcctacagtccctccctttacctctggaaactagttatttctaggttgttttatgttgttaaggttgaccaccttctctttctgttctgcaatcatagtcctatttttaaatggattcacctctcatcattagccttttgtcatggtcattcaattcacaagttgcttattttttaatttcttggctgactaaattttattatgaagacttttttttttaaagagctcagaaatactgtattctttaagttcttgaacttgtgatagtgtctattgcctattttgattgggcaataatttagctggctataaaattcttggattatactctatttcccttagaaattataggcacccatccactgacatttcattgtgctttatttatttatttatttatttttgagatggagtcttgctctgtcacccaggcttgagtgcagtggtgcaatctcggctcactgcaagctctgcctcccgggttcacaccattctccttcctcagcctcccgagtagctgggactacaggtgcctgcctctgtgcctggctaacttttttgtatttttagtagagacggggtttcaccgtgttagccaggatggtctcgatctcctgacctcgtgatccgctggccttggcctcccaaagtgctgggattacaggtgtgagccactgtatgagcacagcctcattgtgctttgtactaaccccctttccctggtctcttccagcttgtcttcttctctcccagtagtttcttcatgaagaggccatgtactatattccatgagatatttcaaactcaaagaagacttcttttatactcttttgataatttgtctgggaatcactgtcttgatttataagagggtttataataaatacagtaaaagagaaacacaacatattttgagacatcagagaagggagaaaccaattctattaatatttggggttagcagggaaggcttagttaagaggtaacatttgacctaagtcttgaaataagggaaggatttggacatgcagtaatgtggagagagtagaagcaagacatgatggttagtgttatgtatcaatttgactgggttgtggggtgcccagatatttggctacacattattctgggtgtgtctctgaggtattctggatgaggataacatttaattggtagactgaataaagcagattgtcctccccaatgtgggtaagcctcatccaatccactgaaggcctgaacaaaacaaaaaggtagagtcacagagaatttgctctttttacctgattatatttgagttgggacatcaatattctcctgactttagatatggactcgagttggaactctgtcattggctgtcctgggtctccagcttgctggctgcagactccaggactccttagcctccataaccatgtgagccatcccttaaaacaaatcagtctgtctctgtctatgtgtatagctctacctctatctctctgttctttctctggagaacctagaataatacacaaggttatattagagaagaagatgacccaaggaaaagcatggagtcagaaaagtgcaaagagggtttgggaagactggggtcctgatggggagtttggatttctctgtgtgtagcatggagaatccttgaaaatagtcaagaggtgaaaattgtatctgtggaagaacaccaggagtatgtgaaaagaaaaacattcactccgttttaactccactgaagggggcatcaaaaggatacactggggacatgggttggagggtagttgaggccatatctggaggatctttacttctaggctgagtctgaatttatctttctggggagtgggagattaaaaatctttgagctccactcaagagatggttttgctaacaatggcagggcgacggtggtggtggtggtggtgggaaactggtagcatgaattctaattgggcttctgttattccagccgagaaagttggggaatggactttcagtagaataatacagacctgggaatcaactgcatggaggaggtagttataggtgatgagatggctcagggacaaagttgtgtagaaggagaaaagatactagtctggtacaaaaataattgctgtttttgccattacttttaatggcaaaatccacaattacttttgcaccaacctaattaggatgcagacttcagagccatctgcatcagagggattgatgaagatcagcaaagtttgggaacacaggaaaggagaggggagggtaatgacttgagggcatagcagggataatcaaggtttttcctgttagcatgtggagacttaagcatgattatatgttaatcgcctggcacatacatggtgcgaaatatttatgagtgaaatgacaagtgaaggtggtgagtcatgggagttccaagggaatgggtgataaagggaggtctcaaatgaggcacaagtggagaaggtagcttgggaaaggagaatgatgcttctccttataagatgggaaaggcagaggaagagggtcaagatacagtgatctaggggtgagatggaagtgagttgagagaactcaactctgggctctgaaacccctagggatgggtttggggggctttgagatatggaagaggtttaaagttaattattatagcaaatatggtttggaatttatttgtcacgcttaaaaatattgctgaacagaagtgaagtctaccctagagttggatggtgagattatttagtggaactaccagatccatgttgtgattcttcccagtatcattcagcagcccttgggcagttgcgaggcaagtcatcaatggggtatggagattttccaggtgggtgtggttgaaggcagggaagaacgcgtttaggagcacattacaagaaggtgactgtaaggtccaggctgagcaggaaggtaaagcaagaaggaaacatgaggttgtgaagagaagtttagagggatgaggaggcaggagaggtgaacagttgcaggatgtagctagagtggcgatgttagatctaggggccagacagctttacaatgatgatgaagatcaaagggcattagaatcaagctataaagagccactgtttgatgttgggatgtgaggatgctgcaggtggatgtgtgcacattgatggtgagaacatggtcaccctggccctgctgggtctttgctaaaaagactgtgctctgttcttggggccgttttcatcacctgattagagcagtggtccccaaatggtgttctttggaccatctgtataaaatgttcataggtcaaggataaaatggaaaaacagagactgtgtcacagaaatgtacccactggtgaaagaccaccagctgtcctttttggaggattgttctttattctaaaaatgtatatattctgttctattaaaacatttttgtatttgcattttttttctcttttatgaaatgccatggggtagaactttgtaatgtatccaattctcctgtcttcatgcattgccctgtggtgggggaggggatgtggctagtactggccaagaggctgggggcagaagtgcagtgttagacttctagcctggagtatttaattcctagtacaagactgtctagcattcttctccctctgttccctgcttggtgatacttgaggtattgcagcccccattagccttagtcttagggcaagtttgatgggaaacagagcaccccacacctccctgcagatgaagcatgagtgagaaaaacaacttctgatgtttgaagttaccaagatttaggagttgtttgttattgcagcaaaacctcacctattctgaccaatcatggtggaatttctgtgtgtatgtgtgtgtgtgtgtgtgtttgtgtgtgtgtgtgtaaaactggtagtttaaaaaagttccttcttaccaaaaagaaaaaaaagtagcaaccttatgttggttctcaaattaataaaatatttttactggtttataaaatagaaaaatctgagaatctgtagcttagagaactacagtgtgggatgcctataaagaccaggttattttatcagctcctaacaccccttaatagaagcttagccaagacttggactatttcagtatttcccattccacattccatggactcttgaagagacattgatgaaacggtgcagccatgaaccaccctcactcaatcctagtggcagaatcccccttttactgcagaatgagcttcttgctacagtgatacttgaaccccttagatatatcctgtactaattatattaaaacacgaccaatgcttttgctttgttgtcccccaaattaaacaccttaatcatgagaacccagagaattggatttagtgtgaccgattccaaactgtcagtaagaacacaattaggttatatttttctccagttcaaataaaagaaaattgacaataaaatgctgatcaatatgtgtagctcaggaggtagagcctgctttgagatgcagaagtgtttgttttttttagatccatattcttcagtaaagaaaaaatccatctctctttcctagaggggaagactttcagagctgggcttggcaacagcctatcagaggctgaattaaacaaataggtacctccctggagtgaatggtgcatttctcctattcggggaaccgtgcttttatggtggagtttgctttctgtcttggtctccggatgtgtgtatctgtggattgatgtctgcatgtaaatggcaatgtatacctgtgtgggtgtgtagaaaattcccatgtgaatctcaggtttgtggggatctccaggtcttgagcccagaagatgccagttgaagaaaagtcacttgaaaatgagacagaaagaacggaaactaaatcctagctctaaaggcaccaggctgattaaaaacaaaactctggatcttctttgttttggactctacctacctccaaatgacatttctgtttcctctgaaatgattagaatgacagagatcctgagcacgaaagagcagatactgtgtgattctgtgtatgtcagggtgtcagctgtgaggctgctgacatttcggctcagcaatttctctgttgtatgtgtgggggttccctgtgcattttaggatgttgagcggcatgcctggatccctggagtcactggatgcagtaacacaacttcctccaagtacagacaacccccagtgtctccagatattgcctaatgtccccagggagcaaaatagccccatctgagaactgctgctttcataaagtacaatgtctggtgaaataggtagaggctgtttttagtcaggcgttagtagagatggaagagaccccaggaacatcctggaaggggctgtaatgttctgtttcttgaattgggtgtcggtaatatggagacgttcaatttttttttttttttttttggcaggatcttgctctgtcacccaggctggagcacagtggcaccgtcttggctcactgtagcctttgcctcctgggctcaagcagtcttcccacctcagccttcctgagtagctggaactacaggcaggtgccatcactgttgcctaatttttgtatttatttattttttgtagagaggggggtctcactatgttgcccaggctggtctcgagctcctgggcccaagcagtctgctcacctcggcctcccaaagtgctgggatgataggcatgagccactgcgcctggccagtatgttcagtttgtaagaaaagtactgtgttgacctcttctatgtgcacatttctttaagtaataattcaataaagcatttagaaaaattggtcataataggagtgatttgtagagtgattggcatgaaagctgatcaccttaatttgaactactctgaaatgagcaccaggggccaccaagtggaacttttcaaggtgtcatagccaaggataggagtgtgttgtgtacatctctgcataaaggatttgctggttacatggaaggatgaagcctccttctgaggacagaggcagcaaggcaagtggaagccgaaaacattgagctttgtaaatggactttgctaaaatcttgtggatgactcatgctcttaacatacacccatgtacatattgtccatataaacattaattctgtaacaagccccacacataagggtatttttttctttcgagacagtcttgctttattgcccaggctagagtacagtggcataatcgtgactcactgcaacctccacctcctgggttcaagcaatgcttgtgcctcagccccccgagtagctgggactacagttgcacaccaccatgcctgtctaatttttgtatttttagtagagacagggtttcaacatgttggccaggctggtctcaaactcctggcctcaagtgatctgcccacctcagcctcctaaagtgttgggattacagttgtgagccactgtgtctggggccacacttaaagtttgagtttagatagagaaactctggcaggactgaggaatttggccacagtctctgggaaatatgcacaatttctggaatcttctctacttgcagagttcccactttctatctgtctcctatttattcaacaaatttgtatggaaccacagtgtgtctagaacttgccaggcgtggaggataaaagatgactgaggtcgggcatggtggctcatgcctgtaatcccagcactttgggaggccaaggcaggcagatcacttgaggtcaggagtttgagcacagcctggccaacatgatgaaacgtctctaataaaaatacaaaaattagccaggcatggtggcacgcacatgtagccccagctacttgggaagctgaggcaggataatcacttgaacccaggaggcagatgttgcagtgagctgagatcaccccgctgcattccagcctgggagacagaacgagattccatgtcaaaaaaaaaagatgactgagatacagactccatcagagttgactctgacacaaatttggtaagagcccaaggtctggctgggcaaggaccttgatcggcttcatcctgcagcctctactagaatgaagagcactttttcctttactcatgaaaatgttttgtgcttcgtacctacaagtacaatttgtgttaattctgcaaaatatgccacataactctgcctgtattcttagcatttttcctttgagagatttctcagcacatcatctttggactatgtggaattggaaatttacttagagtcaacaacaagtacaggaaagtcagttcttagccaagagttaggttttcaaagacagtggataaaataaacaatctagtacagtcaagattatacgtgcaaatcccctcatcattcataaagtttagccgtcagtcttaccgtggctcaccaggtccaatccatacttcttcctccacgattggagcagagggtgattttttttttttatgagcaactgctgaagtcatttagagaccatttgcagtaggagccctgtgtactagagaccaatcaatgtgccctcatggcaccatttctgcctctctccctctttgttcttgccaagtacccatagttcattttccatagattaaaagagcccaagttgggcctatacctaggagtacaattactgggtcatttggtaactctatgtagaattgtttgggaagttgttaaactgtttctcacagtggctacaccattttaattcctaccagcagtgtatgaaagttctagtttctctgcatcctcaccaacacttgttattttctgtattttttttttgagactaagtctttctctgtcacccaggctcgagtgcagtggcacaatctcaactcactgcaacctctgcctcccagattcaagttactctcctgcctcagcctcccgagtagctggtattatagtcacctgccaccatgcttggctaatttttgtatttttttagtagagacagggtttcaccatgttggccaggctggtttcaaactcatggcctcaggtgatccacctgcctcggtctcccaaagtgctgggattgcaggcatgagccaccactccacgccaattttctctatcttcaattctagccatccttatgggtatggagtggtatcacattgtggttttgatatctgtttccctgatgatgaatttcattgagcatcttttcatgtgcttattggccacttgtatgtcttctttggagatgtgccatattttcatattcaaaaaggaaagcacaggtccacacaaaattttgtacatgaataattacagtagcatcactcctaataacccacagagggaattaatccaaatgcccatcaccagatgaagagatacaccgattgttgtctacccacatggtggaatattatttgatcacaaaaaggaggaaagtacatacgctacagcgtggatgaaccttcaaaacagatgaaagatcacattctacatgatttcattcagatggaaatctatagaaataggaagtcgattagtggttgcttagggctggtaggggcatgggaggatagggggtgatagctaaagggtatgaggtttctttttgaggtcatgaaatgttctaaaattgactggtaatgtttgcgtgtatctctgaatatattaaccattgaaatgtaaaaaaatgcaaagaaaaaacagcccaagatgcaattttattcaacacttgattggctttagaaatagattccaggctgggcatggtggctcacacctgaaatcccagcgctttgggaggctgcggtgggaggattacttgaggccaggagttccaggccaaccttggcaacatggcaagaccctgtctgtacaaaaaagaaaaaataaatatcagctgggtgcagtggctcacacctgtaatcccagcaccttgggaggctgaggcgggcagatcacctgacatcagttcaagaccagcttggccaacatggtgaaaccccttctctaccaaaaatataaaatttagccttttgctactctgagcagcaccatggcggttgttaagaacaagtgccttatgaaaggtggcaaaaagggagtgaagaagaaagtagttggtccattctctatgaaagatcagtatgatgtgaaagcacctgctatgttcaatataagaaatattggaaagacttggtcaccaggactcaaggaacccaaattgcatctgatggtctcaagggtcttgtgtttgaaatgagtcttgctgatttgcagaatgatgaagttgcatttagaaaattcaagctgattactgaagatgttcaggacaaaagctgcctgactaacttctatggcatgggtcttacctgtgacaaaatatgttccatggttgaaaaatgttcaacaatgattgaagctcatgttgatgtcaagactaccgatggttacttctttcttttgttttgtgttggttttactaaaaaacacgacaatctgatactgaagacctcttatgcttagcaccaacagtctgccaaatccagaagaagatgatggaaatcatgacctgagaggtgcagacaaatgacttgaaagaagtggttaataaactgattccagacaacattggaaaagatgtagaaaaggcttgccaatttatcctctccatgatatcttcattagaaaagtaaaaatgctggagaaccctgggtttgataggcatggagcttcgtggtgaaggtagtagttctggaaaacccactagggacaagacacatgctaaagttgaatgagctgatggataggaaccaccagtccaagaatctgttttaagttcagacttaaaacagtggcaaataagaagtcctatttgtgaaaaacaaacaagaaacaacaatgaaaaaagcaaaattagcctggtgtggtggtgcatgcctgtaatcctagctactcaggaggctgaggcacgagaatcacttgaacccaggagacagaggttgcagtgagccaagattgcaccattgcactccagcctgggcaacagagtgaaactctctccaaaaagaaacaggaaaaaaaaaagtatcggggcttggtggcatgcgcctgtattctcagctactctgaaggctgagatgggaggatagcttgaggccaggagtaatttgaggctgcagtgaactatgattgtgatactgcactccagcctggactggagagcaagaccctgtctctcatacatacatacatacatacatacatgcatacatgcatacatacatacacacatgcgcacatacatacatatccaggctatacctctggtgattctgactcagtagggtggggtatcccctagggatcctgctgttcagcctggtctgggatccacttttcattgggaactgagacactggctgtgagcctttctgtcctgtgatgtagaggtcatggcgacgcaggttcaagcttaaggagacctgactgtgcgttaggtattgtgctgaacatcatctcttactctcacagcaacatccttagaaggttaatgatgtgtccccgctctacagatgagaaactgagctttgagaggagtttagcttgttcaaaacttattcttcctattggaaaatttgtaccctttgagcagtgtctcctatccgctacctttcctccaccccagcccctgataaacactgtcttactctctatttctgtgagttcaacttctttagattccacatataagtaaaatcatgcagtattagtctttctgtgcctggcttatttcacttaacacaatgtctttcaagttcatctatgttgttgaaaatgacaggcttgctttcttttttaagggttaatagtattccgttgtgtgtatatagtacatttgctttatcctttcatccactgacggacacgtaggttgattctatatcttgggtattgtgaatagtgctgcagtgaacataggaatgtagggatcccttcgacatattgatttcgatttttttttgtctatacccagaagttgggttgctggattatatgctttgaaatctataacacagcagcgtgactatagtcaataataacgtatctttcaaaataactaaaaggctacatttcaagtgtctcatcataaaaattgtcaataaattaggggatggacatgttaattagtttgatctaatcatcccacattgtatacacatatcaaaacatcacataaatgtgtacaattatgatttgtcaattaaaataaagttagttaaaaaaataagtaacttgttcaaagccccagttgggattgatggagccgggacatgcaccaaggcttatgctctcaggctcacagagtccttggtccacaaatgttgaagccctacctgagatttctactgagatcagtgtagggattcgatgtctcagaatcatcccatcctccagggcccacaagtccatgaccgttggctctacccccgaccctgctgacctgaaatgtggcacctgctttcatttccaggagcatacaacacttacaccaagcattgatgggttttattgacttcatttgagattggggccgtggagagggtcccatgatccttgcttggtgttggccaactcattgacttcgctctttgacttcacccttcccttttctactcacctcctctgtcatggattgctctgggaattctgagccctagttcctttattttgcagataaccttcactcttctctgcaacgaatcccaaaagtatgtagttgagctgactgcaaggtgcttgacatgcaagaggctccacaaatgggattcggcctctggaaagtggtggtagttccagatttatgtgtatgttactttgtttttccctataaaatatattctttaaactatcaagctcttggctcctggatgcagtcctttgctggtggcagttggctgggtactgtcactggggagaaatgctgcccacttagagaaagagtaactggttctctttaagaggcagaggaaggtttccagtgccagtttgtttggaggcaaaatggctgttgtattaaaattgcccaaacttgggctggtgccttgtgtgtttagagctcaaagccatgattgttttcattttttttttggtggtcggttttacatccttttgcttggtaggtttctgctaatagcttcaacctcaagagtgccattatacagacactaatagcacctactatgtgtcaggcattggagataatataatgatgaacaagataaacatggcacttggaaaagagagtctagttcccactctcagcccaccccaaagagaggccagaattgggcttccaaagatctcagatgcccttgcagcacctccctgtagagggcgggtgaagccttggtgtctgaagagaatttggctggacaatccccgaggtttggaacgatgggaaagagctgccatctgtgtttaaggtgagaaggggggagtggctgtatatcagaggaagccaagatgaagagaaggtttttgtgagttcctatgcatagtggagacctgttctagtgagggtccctggggctgagcctgtggttcagtggaatgatgctgtgaggagggtctttttatagcagatggcccaaaaaaggctgatggatcatgagcagctggaagaatggagagttcgggggaaggagttcctacctggctttccaacagtgtgtaagcccagaattcttacataagcccatggagaagggaaagcaatgatggtaatgacaagattgaattctccacctgccaggcatccagggactcagagcagatttaactgaagttacagaaataggaatgtgacatttcctacatccggatgtgctggagcaaaatgtattccctctctggtttgtgaggaaggagaatgctaacagacaagactccaggttttcgctcttaaacctggtgcctagaaatgcattttctactggatgcagacagaagctccatatagacatatccatcgctgcatctctcatgccttgtgttctccctaattttccctttttaacccacagaggaagaaagttcaagcaccacttctggcctctcaagagtgagtttggtggccaggtggggttattcatgcctgtaatctcataatgaaggggtggcctgcccctccacacctgtgggtatttctagtcaggtgggatgagagacaaaaaagaaataagacacaaagtatagagaaacaacagtgagcccaggggaccggcgctcaacatactaaggacctgcactggcacaggtctctgagttccctcagtttttattgattattatcttcattatttcagcaaaaaggaatgtagtaggagggcagggtgataataaggagaaggtcagcaacaaacatgtgagcaatagaatctatgtcataatgaagttgaagggaaggtactatgactggacgtgcacgtaagccagatttatgtttctctgcacccagacatctcagtggagtaaagaataacaaggcagcattgctgcaaacatgtctcacttctcaccatagggcggtatttctcccatctcagaactgaacaaatgtacaatcgggttttataccgagacattcagttcccaggggcaggcaggagacagtggccttcctctatctcaactgcaagaggctttccactttgactaatccacctcagcacagaccctttatgggtgtcgggctgggggaccatcaggtctttctcatcccacgaggccacttttcagactatcacatggggagaaatcttggacaatacccagctttcaagggcagggctccctgcggctttccacagtgcattgtgcccctggtttattcagactagagaatggcgatgacttttaccaagtatattgctttcaaacattttgttaacaaggcacgtcctgcacagccctacatgccttaaaccttgatttcatacaacacatgtattttgagctccaggtttggtcaaagtggtgggggcaaagtggctggggcaaagctacagattaacaacatctcagcaaagcaattgtttaaagtacaggtttttttcaaaatggagtctcttatgtcttccctttctatgtagacacagtaagagtctgatctctctttcttttccctacatatcccccttttcgttttgacaaaaccaccaccatcatcatggccccttctcgctggtcgctgtctctctggagctgctggatacacctgtagactaataatagaaaagacagacagacaaggattaatacaaaatttacaataatggaatttccggtggttttaacccaagtgacgggggcaagaggacggtgtgggtacttcggtacccgggcagtctcccacctcctttgtgtcttagttgctgtttctcatagttttcagtctttctcctcacctgctcactcgcaccttttatctctttgtctcccttctcttatggtctctctctctctcttttacactatctctctccccagtctcactttttgtgtctgtctctgatctctgtctctttttctttctattcctcgtcctggctctccacatgtgccattttcttggtggatggtaacttcatctcttcttctgatatcaccattttgttcaccctgcgagtcgatgatgctcgattgcgtgttttctgtctctgcggaggcactttcatttgcatctctgataggttcattgtagaacttcaaatgtctagtgggtatccaaacaggaagctgattttcttctggtgaaacacgaacaaaacctctcccccatgttatcactttacctatttcccatgttttgttttgttgtctttccaccaaatcaattttcactcatgtgggctgttcttttcaccagtaaaatgttctgcagaagtagtggtctcatttctatgtatgtttagaaaatttaaagtatagagtgttagattaagttgcatctgggaagtgttatactccttactgtctgtttcctttttttgtttaaccaattgagctttgagtgttctaagcaggacaggtaagatctgcgtctggcacagccagccaggtctccttaccctcggcctccctttctgcctgtgactgaatgggtatgtcatggtctagtaggggatccaggaggaggaagcctcattaacttctattctgcagcaattgatggccacccaacttgaacagtgggggcttatcacctcatgtattaagaccggagatagctgatgccaaggttggctaaattagtagcatgagatgttaggtttttcatttgaggtttctatggtgctattgccttctgctcttggtcacagaggctgccacaatccgcatgtcaagtcctcatgtgacaatatccagacacagcaaggaagaggtacagtgtattcctgcatgtttcttaaaaaaatatttttgatagagaataattgtacagatttttgggttccatgtgaggttccggtacatgcatgcaatgtgtaatgatcaaatcagggtctttaggatattaatcacctcaaacattgatcatttctttgtgttgggaatatttcaaatcttattgctatttagaaatatacaataaatccatttatcaggatacaaaatctatgtacacacatcagtagcagtgctatacaccaacatctaccaggctgagaatcaaatcaaacccttttataatagctgtaaaaataaaatacttaggaatatacctaaccaaggaggtgaaagactcctacaaggaaaactacaaaacactgttgaaagaaatcatagatgacaaaacaaatggaaacacattccatgctcatggatgggtagactcaatattgtgaaaatgaccatactgccaaaagcagtctacaaattcaatgtaattcctatcaatataccatcatctttctttatagaactggaaaaaaaaaatgccaaaattccgttggaactaaaaaagagtctgcacagccaaagcaaaactaagcaaaaagaaccaatctagaggcatcacattacccaacttcaaactatattacaagactatagtcaccaaaacagcatggtgctagtataaaaataggcacatgaccaatgggacagagtagagaagctagaaataaagccaaatagttaacagccagctgatcttcgacaaagtaaacaaaaacaaagtagggaaagtacaccctatacaacaaatagtgctgggataattggcaagccacatgtaaaagaataaaactgaatcctcatctctcaccttatacagaaatcaacataagatggatcaaagacttaaatctaaggtctgaaaccataaacattctagaagataacattggaaaacgcttctacacattggcttaggcaaacagttcatgaccaagaacccaaaagtaaatgcaacagaaacaaagataaatagatgggactcaattaaactaaaagcctcctgcacagcataggaaataatcagcagagtgaacagatcacccacagagtgggagaaaattttcgcaaactgcatctgacaaaggactaatgtccagaatctacagggaactctaatcagcaagaaaaaataatcccatcaaaaagtgtgccaaggacatgaatagacaattctcaaaagaagatatacaaatggccaacaaacatatgaaaaaatgctcaacatcactaattaccagggaaatgcaaatcaaaatcacaatgcaatactacatgtaaaataaacaaaaatagggccgggtgcggtggctcacgcctgtagtcccaacactttgggaggccgaggtgggctgatcaggaggtcaggagtttgagaccagcctgaccaacatggtgaaacccagtctctactgaaaatacaaaaattagccgggcatggtggcagttgcctgtaatcccagctactcaggaggctgaggcaggagaattgcttgaacccgggaggcagaggttgcagtgaactgatatggcaccattgtactccagcctgggagacagagcaagactccgtctcaaaaaaaaaaaaaacaaaaaaagcaaaaattggtgttgacacggacatggtgaaagaaaacgcttttacactgatggtgggaatgtaagctagtaccgccactatggaaagcagtatggagattccttaaagaactataagtagatctaccatttgatccagcaatcccactgctaggtatctacccagaggaaaagaagtcattatatgaaaaagatacttttgcacacatgtttacagcagcaaaattcacagttgcaaaactatagaaccagcccaaatgcccatcaatcaattagtggataaagaaaatgtatatatatatatgtatacacacacacacacacatatatataccatatacacaaatatacacatacacaaatatacacatatatataccatagaatactacttagccttaaaaaggaatgaaataatggctttcatagcaacctggatggagttggagaccattattctaaataatgtaactcaggaatggaaaaccaaacattgcatgttctcactcttaagtgggaggtaagctatgatgatgcgaaggcacaagaatgaaacagtggactttgggggctcagggggaaggtgggaggggttgagagataaaagactatgcattgggtaaactgctttgctgatgggtatgccaaaatttcagagatcaccactaaggaatttatccatgtaacaaaataccacctgttccctaaaaactattgaaatgaaaaatatatatacacaacaaattgttgtagtcactttctgtgataatgaacactagatcttattccttctattatatatttttatacccattaatcaacttcttttcaaacccctcctaatcccagcctctggtaactatcattctattctttatctccatgatatcaattttatatagctccagggcacacaagtccataattgcagtctctatccctgatcctactgacctgaaacatggcccccactttgatttccaggagcataaactgctcatataagtgagaacatgaaatagttttctttctgtgcatggcctagttcacctaactttatgacctttaattccatccatttagctgaaaatgacaggatttcattcttctttatggctgagtactattctcttgtgcgtatattcccattttctttatccattcatccattgattgacacttagattgattccatatcttggctactgtaaatagtgctgcagtaaatatgggggtacagatatcccgttgatacactgatatccttttttttgggtatatacccaggagtgggattgctggatcatatggtagatctgttcttagttttttgagaaatctctgtactttttttcatagtggctgtactaatttacattcccaccaacaatatacgataattttcttctcttcacattcttgccagcatttgttgtgctttgtctctttaataatagccattctaacaagtgtgagatgatatctcactgtggttttgattcgcatttccgtgatgattagtgatgttgaatattttttcataaacttggtgatttgtatatcctcttttgaggaatgtctgtttattttttgatagtttcttttgctgtgcagaagctctttcatttaattagatcccatttgtcaatttttgcttttgtggcaattgcgtttggcatcttcaccatgaactctctgcccatcactatgtaccggatggtattgcctaggttgtcttccagggtttttatagttatgggttttacatttaagtctgtaggccatcttgagttaatttttgtatatggtgtaagggaggggtggtgtcttttcactctgttgattgttttctatgatatgcagaaggtatttaatttaatataatcccatttgtctgcttttgttgcttgtactttttaagtgttagccatacaatctttgttctgaagcgtttctcctgtgtttatttccagtagttttatagttgtggctgttacatttaagtctttaattgattttgagtttatttttgtaagtgatgagagataaaggtctagttttattcttctgtgtttggatatctagttttcctggcaccatttaatgaagagggtgtcttttattcaatgtacgttcttgacacctttcttgaaaatcagctgtaaatatgtggattcatttctgggttctttagtctgtttcctttgtttttgtgtgtgttttaataccaatacacgctgttttggttactatagctttgcagtatgtgtatatatatatatatattttgtttgtttgtttgtttttttgagacggagtctttccttgtcactcaggctggagtgcagtgatgcaatctcggctcactgcaagctccgccttccgggttcacgccattctcctgtctcagcctcggctaatttttttgttttttttttttagtagagacggggtttcaccgtgttagccaggatggtctcaatctcctgacctcatgatccaccctcgttggcctccccaagtgctgggattacaggcgtgagccaccacgcccagctgctttgcagtatacttttacgtcaggtagtgtgagacttctagctttgttctttttgctcagttttgctttggctatctggggacttctgtggttccatatgaatttcagggtttttttttttttcctgtttctgtgaagaatataattgatagggattatactgaatctctagattgcttagggtagtatggtcattttaacagtattagtaattccaacccatgagcatgagatgcttttccatttgtttgtgtcttctcaatttatcagtgttttgtggttttcattgcagaggtctttttttttctttttccccatccttggttaagtttattcctaggtattttatttttgtagctattgtaaatagaaattcttccttggtttcttttttcgctagttttttactggtatatagaaacattactgatttttgtatgttgattttgtgtcctgaagctttacttatacatctgtttttttaaaaattttttgttttttattttttgagatagagtctttctctgttgcccaggctggagtgcagtgatgcaaccttcactcactacaacctccgcctctgggtttcaagcgatactcctgcttcagcctcccaagtaactgggattacaggcacctaccaccatgcctggttaattgtatttttaatagagacaggatttcaccatgttggccaggctggcctcaaactcccaagctcaggtgatccgcccaccttggcctcccaaagtgctgggataacaggcatgagctaccatgtccagcctaatttatcaatttcaagagtttttggtggagtctttaggtttttctgtttacaagtataagattatgtcatctgcaaagtgagacaatttgacttcctcttgtctagtttggatgccttttatttctttatcttgtctgatcactctggcttggatgtcccatattgtgttgaataagaatggtgaaagtgggcatccttgtcttgttccagttcttggaggaaaagcttttcagtttttcccagtgagtaggatattagctgtagattagtcatatatgccttttcttatgttgaagtgttccttctatgcctaatttgttgagagttttcatcatgaaggaatggtaagttttaccaagtgatttttctgcatctgctgagatgatcagatagtttttgcctttcatcttgttgatgtgatgtatcacatgcactgattttgtgtatgttgagccatctttgcattcctgggataaatcccacttgatcatggtatattatctttttcattcatcattagatttggcttggtagtattatgctgagaatttttgcatctgtgttcattaggaatattggcctgtagttttctctttctgttgtgtccttgtcttgattggatatcagggtaatgctggccttatacaatgagttaggaagaattccctcctcttcaatttttgggaatagtttgagaagtattggtgtttgtttttctttataaactgggtagaaatcagtataaaagcctggtctagggcttttctctttggagagactttttgttactgattcaaacctgctattcattttgagtcagttcaggttctctctttcttcctagttcaatcttggtaggctgtgtatgtctgggaatttatccctttcctctaagctttccaatttgttagggtatggttgttcgtaatagcctctaatgatcctttttatttctttggtaacagttgtaatgtctcctttttcatttctgattgtatttatttgggtctcctttctttttttttggttagcctcactagtggtttatcaattttgtttaacttttcaaaaaaacaacttttatcttgttgattctttgcatttcttttttgtctctgttgcatttggttctgctgttattttttttttctttctactaattgtgtgtttggtttgttcttgcttttggagttccttgaggtgcatcgttaggttgtttatttgagatctttctacttttttagtgtaggcatttattgctatgaacttacctcctagtactgcttttttctgtatcccataggttttgcatgatgtgtttccattttctgtttaaaaaatttttttgatttccatcttaatttcttcattgacccaatgatcattcaatagcacatttattgttcatgtatttgtacactttccaaatttcttcttgttattgatttcaagttttattccattgtggtctgagaagatagttgatatgattttaatgtttaaaattttgttgagccttgttttgtgtcctaacatatggtctatcctggagaatgttccatgtgttgatgagatgattgtgtattctgctgctgctggatgaaatattctgaaaatatctgttaggtccatttggtctaaagtgcagcttaaatctaatgtttgtttgttgattttatgtctagatgaactgtccaatgctgagagtaggatattgaaattctcaactatcattgtattggactctatctctccctgtagatttaataatatttgctatgtgtgtctggatgcacttgtgttggttgcatgcacatttagaattgttatattttgctgcttaatttttccctttattaccatataatgaccttctttgtcctttttacagtttttgacttaaagtctgttttatctgatgcaagtttagctactcctgattacttttgatttctgtttgtgtggtatatttttttcaatcccttcactttcagtctgtgtgtgtctttacaagtgaagtgagtttcttgtagatgttgttgggtcattttttatccattaagcctgtctgtacctttaggtaggtaatttaacacatattcgaagttattattgataggtgaggacttattcgggtcattttgttcattgttttctggttattttgtatatccttttgatttggtttggctgtgtccccactcagatctcatcttgaattcccatgtgttgtgggagggacccagtgggaagtagttgaatcatgggggcaggtattttccatgctattcttttgatagtgagtaagtctcctgagatctgatggttttaaaggaggagtttccctgctcaagctctctctttgcctgctgccatccctgtaagatgtgacttgtctctccttcacttccacaatgattttgaagccttcccagcaacaaagaactgtaagtccattaaacctctttcttttgtaaatttcccagtcttatatgtgtctttatcagctgtgtgagaatggactaatacagtaaattggtaccagaagtggggtgttcctaaaagatacctgaatatgtggaagtgactttggaactgggaaacaggcagaggttggagggctcagaaggagacaggaaaatatgggaaaagttggaagagatttcctagagacttgcccaaaatgctaatggttatatggacaataaagtctaggctgaggtggtctcagatggaaatgagaaacttgccgggaactggcacaaaagtgactcctgttatgttttagcaaagagactggtggcattttgcccctgctgtagagatttgtggaactttgaacttgagagagatgatttagggtatctggtagaagaaatttctaagcagcaaagcattcaagagatgacttgggtgccgttaaaggccttcagttttataagggaagcagagcataaaagtttggaagatttgcagcctgacaatgcaatagaaaagaaaatcccattttctcaagaaaaattcaatctggctgcagaagtttgttgaagtaacgaggagtcaaatgtgaatctccaagacaatggggaaaatgtctcaagggcatgtcacagagcttcatggcagcccgtcccatgaaaggcccagaggcctaggaagaaaagatggttttgtggactggacccagggacccctgctgtgagcagactcgggtgcctgagtcttagccactccagctgcagctaaaaggagccaaggtacaatgtgggctgtggcgtcagagggtgcaagccccaaaccttagcagcttccaaatagtgttgagcctgtgggtgcacagaagtcaaaaatcgtggtttgggaactgctgcctagacttcagaaggtgtatggaaatgcctagttgtccaggcaggagttggctgcaggggcagggcactcatggagaacctgtactagggtagtgcagaagggaaatgtggggtcagagcccccacctagagcccctactgcagtaccacctagtggagctttgagaagacggccacaatcctccagaccccagaatggtggattcactgacagcttgcactgtgtgcctggaaaagctgcagacactcaatgccaacccatgaaaggagccaggagggggtttatacccacaaagccacgggagtggagttgtggccttttttctcccaaagccatgggagcccacctcttacatcagcatgacctgcatgtgagacatggagtcaaaggagatcattttggagctttgagatgtcagtgccccactggattttgggcttgcatggggcctgtagcccctttgttttggcaattttgtcccacttggaatgactgtatttacccaatgcctatacccccattgtatctaggaagtaactaacttgtttttgattttacatgttcataggcggaagggatttgccttgtctcacatgagactttggactgtggacttttgagttaatgctgaacttagttaagactttggaggactgttgggaaggcataatttgttttgaaatgagattaggcaagggccaggggcagaatgatatgctttggttgtgtgcccacccaaatctcatattgaattcccacatgttgtgggagggacccggtgggaagtaattgagtcatgggggtaggtctttcccatgctgttctcgtgacactgaatacgtctcacaaggtctgatggttttaaaaagggtagtttccctgcagaagctctctctttctctgcttccatccagctgagacatgacttgctttttcttgccttctaacatgattgtgaggcttcctcagctacgtggaaatgtaagtccattaaacctctttattttgtaaactgcccagtctcagtcaggtatgtctttatcagcagtgtgaaaacagactaatacacctttgttccttttttctctcattatttattgttgcagtttggtggttttctttagtggtgacgtttgaatcctttctcctttgtgtgtctgcgctaccatgagttttatactttcatgtattttcatgatggtagatattgttcttttgcttcccagtgtaggactcccttaagcattttttgtaggaccacaacaaacaagacacaaacaaacagtcttttgcttatctgggaaatattttttctcttttttaagcactggagtctcactctgtcacccaggctggagtacagtggcatgatcatagctcactgcagccttgaactcctgggctcaaatgatcctccttcctcagccttctgagtctctggaattgcagatgtgagccactgtgccagtcttcttcatttgtgaaggatagctttgctggttttagcaattttgccttacattttttttttttttaacttgtagtatacatccccttttctcctagcctgtaaggtttctgctgagaaattccccgttagcctgatggagattctcttataagtgacttgatgcttttctcttgctgtttttagcattttctctttgtcttttgacaattttaccataaagtccttggagaagacctttttgagtagtgtttatttggtaatctttgagattcctttatttggaagctttcaggaagtgttcagttattattttattaaataggttttctatgcttttacccatctcatctccatccagaactcccagaatttcagtttttggtcacatatgtgtcccatatgtcatgtagccttgcttcattcttttttctttctttttgtctgactggattattttaaaagactagtcttcaggttcagaaattctttgttttgcttgatctagtctattgttaaagctgtcagttgtcttttgtatttctttcaatgatttcatctcttccaggatttgtgtttggttctttgttatgctgtctatccctgttgaatttctcattcagatcatgaattgttttcctgatttttttgtattcattatctgtgctctcttatatctccctgagtttctttaatatcattattctgattttttttcaggcatttcatagattttcttttcattgaaatctgttgctggagaattattgtgcttctttggagattttatgtttcctttttcatatttcttgcgtccttatgtgactacttgtgcctctgacatagcagtcacttcttccaattttctgggttggcttttatatgggaaagaccttttcttatagctgtatctacagcgttcattggatatcacactttggctttgattctgggtgggtacagtggtataggctgcatatgatttcttcagctgtaattggcatgagtggtgtctgtgagttattcagtggcttagacagcagttttttttgtttgtgtgtttgtgattgagatggagtctagctctgtcaccaggctggagtacagtgacacaatctaagctcactgcaacttctgcctcccaggttcaagcgattctcctgcctcagcctcctgagtagctgggactacaggcacctgctaccacgcccagctaatttttgtatttttagtagagatggggtttcaccacgttggccaggctggtcttgaactcctgacctcgttatctacctgcctcagcctctcaaagtgctgggattacaggtgtgagccactgcgcccagccagactgcagttgttattggaggctgtggtgaggctttgctgaggatggggatgcctggaagtcttgtccttcagcatcagtggtagtggtggtagaacaggtgtgtcaatactagtgaccatgtgcagtgtatgtgggcactgatgatagcctgtctgcatgggccaatccctgggcctccaggtggcttctttggttgctggcagtggcagcactgggccaggtgggcgggtgcgccactgggctcctgggttgtgtgtgtggcaggctgatctctagttctccaggtgacgtgtgcaggttctggtggtgggtaggcaggtgtttcctcaggcctctcagtagtaagtgtgagcgccagctctggaggcagtgtgagtcagtctccaggcccccagatggtacattcaggcaccagcatattcctatgcatttctagataatagtatttttcagaaaacctgagcatatgtcctattaatacaactttccctcatcagctctgcatgagaagaagggggatttccctcagtagaacagtcacaatggaatcatagacttgttttgagccactcactggtatgtgggggtaggctaaaatgataagctcagaatctaaaccttagactagggaatggctaactttttccataaagaagcaaacggtaatattttaggcttttggtctgaataacctctgttgcagtgacgcagtggtgccatcgtagtttaaaacatatgtagacaaggcataaatgaatggacctggttttattccagtaaaacttaatttatacaaacagtcagagggccagatttggcccttggtctatagtttgccaaccctgtttagacaagtcacaatttattccctggggctgggccaattttttctaaaaaaaaaaaaaaaaaaaaaagaaagcaacccgctttcagaataaaatagggtttctatttaaaaagaagaggctgggtgtggtggctcatgcctataatcctagcactttgggagggtgaggcaggaggactgcttgaggccaggagtttgaaaccaacttgggcaatatagtgagatcctgtctttgcaaagaataaaaaaattagccaggcatggtggcacatgtcaggagtcttagctacgtaggaggttgaaggggaagatcaggggagcccaggattttgaggttacagtgagctctgactgtgccacttgtactctagcctaggcaaagaataagactccgtttcaaaaaaaaaaaaaaatggttggttggggtgggttggagaagaaagtatttctgaatttctgggtaggtaactggtagtgtcagggcaaactagctctacagtcttattcattataaataaaggcaactagaagatctccatctagctattaaaaattggttaaaatctacagagataaagtatggtgacccttgtatcagttagttattgtcacaaaatgctgcataacaagtcactccaaatctcagtggcttaatacaacagttatttattttcatggatctatgggtcagctgaggattggttaatctagcataagcatgtctgggaagctctactttgctcttggtgtctcttatcttctgctggaagcagcaggctggcctgggcttgttctcatggtgatagcaggagtgagcgagcacaaatgaatgcacactttccaagtttttggtcatgcagattaatattccagtggccaaagctagacacatgactaaacccaacattaggggctggagaaatatactctgattcttcagtgggaggaactgcagagacaaatgacagagtcttggatacagggaggacacggatccattaatgtaccttaatcaaccgcaaccctctaaccaccaatgcaattaaataagtatttgttgaatgcacttgtgcctgaatgcttctggctgcagcccaggcaatgggggcctgactgggaagggaccatagcagggactcgatgtcctgcaggtctgcatgtaactgtgcacggccgactccccattggtcatggctgatttgctttatcctgcgaccccaaggggcaacgattacctgattttatttctgaacagttttgacaaagttgttttcaggagcccaggaagcaaatcaattgtagatttgaattttgcagggggtcagaattgtttaatatatatatagtcttttacatgctgataattatttccataccacaaagaaggccggctattaggaggctgctgttcaattcctttgccccgtgagctcatgagctgtgtctatgtggggggcactcacttgttagagatatttcccttcagaataacattagccaatattctaaataaatgcaggaaattaaatagtcttccccagacaggtactttgcacttctaaagtgaattacacattctaaaataaaacacagtcacattaaaaaaacaaaaggtctttgtgttaggttggtctggcatcagcaaagatattttcctccagagtagaagatccttgtaatgcacgatattgcgtgtggcagccccacatctcgtttccttttttttgttgttgttgtttttaactaaaagagttgacaattttattttcacatttcccaatacaaatgaaaactgcatcttttttggtcccacttctcccctccaaaactattctctttgatagggcaacggggcaagtcttccttatgctgttaagaaaacccggcatcacagcagcatgatctcctggtgaagggagcaggtaaatataaaactcatataggccgggtgcagtggctcacacctgtaatcccagcactttgggaggctgaggcgagcgggtcacgaggtcaggagattgagaccatcctggccaacatggtgaaaccctgtctctactaaaataaaaaaaatcagtcgggcatggtgcgcatgcctgtagtcccagctactcaggaggctgaggcaggggaatcgcttgaacgcgggaggtggaggtttcagtgagctgagatcgtgccactgcactccagcctgggcgacagaggaagactgtgtctcaaaaacaaaacaaaacattacaaacaaagaaaacacaacaataataacaacaaaacaacactgatgtaatgaggcctcccctctatccttatctgtctggttgagtcattctgggctgactgggcaccatcatgagacgggcaggaggtctcatcattgggcacccaggcatcatgggcatgtggccttccatgggtggcctcattccaggagcaggtctcactggcatcatcccaggaggaggagggcccatcattggcatcatgggagggccccccatatggggtgctgccatcattctgagatgtgctagaagtgtcaaatacacattagattgtgaagacttaatataaaaagaaagcaaagtattttgttaatgttaaaatattttatacttgtagacctggtatttcggatagatttgtttaaatctgtgatattattccaattaccttcacttcttttgttttactttttaaaatgtggttactacaaaatgcaaaagtaaatatgtggcttccatcatatttcattacatttagtgtggaccctgaggatctaggggagttatgagccttaagttgagggtgacccaggtcaacatgaattgctctgaaagagaagcaaagggcataaagagaacgtataaatggagagagggagtgaggaaaggctttctttcttacacagtctggcacttcttcaaaagcttaaacacagagttctatgacccagcacttccactccagtttatgaaagaaatgaaagtatatgtccgtgcagaaacttgtacacaaatgctcatagcaacattattcataatagcgccaaagtgaaaacaacacaaatgcttgtctactgatgagtggagaaatagaacatggtttgaccatgcaatggaatattattcagtcatcaaaaggaatgaagtactgacacgtgctacaacacggatgaactatgagaatattatgctaagtagaagaaaccagtcacaaaaggtcacatattagaagatttcatttatatgaaatgtccagaacacgcaaatctatgaagacagaaaccctgtctctactaaaaatacaaaattagatgggcgtggtggcatatccctgtaatcccagctactctggaggcaggagaattgcttgaacctgggaggcagaggttgcagtgagccgagattgtgccactgcactccagcctgtgatagagactctatctcaaagtagattgtcaggacttagtgggaggaggaaatggcaggaacctgctcatggatacagggtttcttttggagtgatgaaaatgttttaaaattgataatgatggtggtcgccgagctctgtgaatgcactgaaactattgatttgttcactttaaattggcaaagcatacggtacctgaattataatagtaatattaaaaaagtaaaatcttccttgaagagatgacacttaaggagaggcctagggggtgggatgagttcactatgtagagaaatgaggaacagcatttcagggtgaggaacagcatagtgaagtccctgaggttgataggcatagagcagatttaagggacttttgtttttgagacggactttcagtcttgacgcccaggcttgggtggagtggtgcgatcctggctcactgcaacctctgcctcccgagttcaagcgattttcctgcctcagtctcccgagtagctaggattacaggtgccgtccaccacacgtggctaattttgggatatttagtagagatggggttccaccatgttgaccaggctggtctcgaactcctgatctcaggtgatccagccgcctcagcttcccaaagtgctgggattacaggcgagaggcactgcgctcagccagatttaaggcactttcaagaagtttatgtggctgaagcctgcagggcaagcaagagaatcaggaaatgaggctggagaaagagaggggctaggtcatggagggtctcacattagggtgtggaaacttacacgagtggtcccaccttgggcatcccacctaactactctgtgtcccagcttccccactggtgagatcaagggctgatgtagggatggaatgagatagtgtgtgctcagtagaggtgaccttttatcatttttttttttttttttttttgagatggagtctcactctgtcacccaggctggagtgcagtggcgcgatctcgactcactgcaagctccacctcccgagttcacgcccgtctcctgcctcagcctccggagtagctggactacaggcgcccgccaccacgcctggctaatttttttgtatttttagtagagacggggtttcaccgtgttagcgagaatagtctgaatctgctaacgtcgtgatccgactgcctcggcctcccaaagtgctgggattacaggcgtgagccaccgcgcccggccgagcttttatcattgttaacccacacagcagtgggagccacggaaagttgagtgatctgtttggatgcaccttctgaagtgattgctttggtccctgtgaggagtgcagattgtcacagggccagggaaaagcagaggccagtctggaggcatttgcagtcaaacacctggaggtgatggtggcttggtttatgatggtgtcaggagagtggctgagcagtgaaggatatgagaaagatttaggaggtaaaacccacgtgacttggtcactgaatgtgggttgtgtgggctggagggaaggtaagaaagaatgagaagaaaaacatactcaagttttgtaggctgtacagggagcatgacactgacatctgctgagcttctgtagaggcctcaggaaacttacaatgatggcagaagctgaagtgggagcaagagagtaaggagggaggtgctacacactcgtaaacaaccagatattgcaagaacgcactcactattgcaaagacaggaccaaaaggatgacgataaatcattcatgagaaatccacccccgtgatccaatctcttcccatcaggccccacctctaacacttgggattacattgcaacatgagatttgggagcggacacatattcaacctgtcagctgctttcattctatgggtgacagagctcagtatctactacaagagactgtatggcccacgaagtctaaaatatttactatctgatgctttcaagtaaaagcttgcaaaccctgctcttgaaaaggaaaggaagggagaggagaggaggaaggctggaaggagcagagaggaacacggggctgtattcaaacatctgttgttaagaaggagaaattcaatttatttggcatggtccaagttatcaaactaggagcactccattgaagtttcaggacaaacactgtgctgaatataaggatgaccccatctgtaatgcctaaccttgtttttattaactttgttcttagactttccttttcttttaatcacttagccttgtttctacctgaattgactttcttttagctaagagagctagacagactttgtcttggctttttcactggcagccccttcctcaaggccatctcttggccgccagctaaataaacagacttaattcatgtcaaagtgtggcattttctctaactcgctcaagtacaacatttggaggcccgagtgagaaacgccacgaggcaagagctgggctcgctccgggcttccccagaaggacggccggcttgtgggggggtgccatctgaaaaaaaattgcaggtccccgaaaggtgaccgtcttccagaggagagcggatcgactaccgtgtggatgattaggacagtttcttcctttttttttttttcagacagacaaggggagggtttcctgtgatgggatcagtcagatgcctgcctggccgctccccctgaggggacttgggctcctcttagcattggcaggcaggaataaacttccggctcagatcgagctatgcctgatgctgccttaagccttatgaggtcgccacggaaccgcaggtgaggtgaggacctacttgaactccgtagctttcgccgtggagctacaaactggaggacaagcgcgagcccttgtcctccctcactcattcattattcacacagagtatataacagttttttttttctttcttggagattcttcaagaaactcgaacaagagaaagatgagagatagaaaaggagagagagagaatgaccggtctgccagaaaccaggactcagtcctccagcatcctgggatgtggactgagtcaagggagggcccctgtcagggccacttccctcctagaaagagacacagaggtgcctgacagaaaaccagggctctaccttctagcgtcctagagaaacaggcagagtcgaaagagggacaccctcatcagggccgcttccctcttactagaactgaagtcaaatctgacctacctgacctcggggtcagaagtcgaggactcagaggtggaattcttatgggcacccacagggtagtcgatccgctctcctctggaagatggtcacctttcgaggacctgaagatttttttttaggtggcaccccccacaagccggccgtccttccgggggagcccggctctcgcctatggcgtttctcgctggggcctcccaatgttgtacttgaatgagttagagaaaatgccacactttcgcatgaattaagagtctgcttatttagctggtggccaagaaatggctaactcttaaagttctcttggccccgaagaaggggctagattttcttttatacttcagtttagaaaggggaaacgggtctagttaaaagaattttacaggagtaaagtagacaaaaaagttaaaaggataaattgttacaggaaagtaaacagttctaggtctaagggctttaagactattacaaagtgatagacgtggggctttaggcattatcaatcggacaaattcctgggaactgcggatattgctcgccccacagtatcttatcagttaattgcattcttagatgtgctaagagtcagcttgcacaagttaagtccttgaggaaggggctgccagtgaaaaagccaagataaaagctgtccccagtgttagaggtggggcctggtgggaagagattggatcatgggggtggatttctcatgaatgattttgcatcgtccttttggtcctgtccttgcaatagtgagtgagttcttgcaagatcgggttgtttacgagtgtgtcgcacctccctccttactctcttgctcccgcttcaccttctgccatcattgtaagtttcctgaggcctccacagaagctcagcagatgtcagtgtcatgctccctgtatagcctacaaaactgcgagccaattaaacctcttttctttatatattacccaatctcaggtatttctttatagcatgagagaacagccaaatccagcagccatagacaatatgtagcaaatgtgcatggctgtgtttcaataaaactttattgacaaacacatgtgcaagcaggtcagatttggcccatgggccatagtgtcccaacgtctgctctggaatattctgttcagcctggatggacatctctaggttgtttttttttttttgagacaaagtctcactgttgcccaggctggagtgcagtggtgcattctttgctcgccacaacctctgcctcctgggttcaagcaattctcctgcctcagcctcccaagtagctgggattacaggcacctgccaccacacctggctaatttttgtattttttaatagaaatagggtttcatcatgttggccaggctggtctcaaactcctgacatcaggcgatccacccacctcggcctcccaaaatgctgggattacaggtggccgccaccacacctggctaattcttttatttttagtagagatgtggtttcactatgttgccctggctggtctcgaactcctgatctcaagtgatccacctgcctcggcctcccaaagtgctgagattacacctgtgagccactgcagctgccctctagatttttcttgtttttttgatcattgcttatttggtttgactttcattttcttccccattgtggtagtcgttttctgaatgcctgttagtttgtccatctctctcctctgtagtccctagagtcagatgaactcctctgcaggtgcaatggtgtaacactctctagtgctgaattttgagcaggagaaagagagcaagagtgaccagtacctttggaaactctggcctcctgagaatttggtgtctcctctgcaaaggttgcatacctgttaacccacaggcaggagagacagacaagccagaatcatgatctgttgagcttgagtttaataactgatgcacagagatcactgagttttttgataagaattagagtaggaagaaatggccacagagaacaatttatatctccaggtgaggactcaggagataattctgcgaacagaacttcctgagaactgagatggggtaaatcgctggtattagaagagtgaaaatgtcagtaattaaggctacgactgtgctcttagaggcaaaagaagaaaatgagactgccaggcatgaataatgagaaatctttgatggaattagccatgcagaacagatactaaatgcatcctcattcttctcatagtcaaaagtttctgcttaagctggatgggaaaaagagaatcccatttcactaagtataaaagaggggattttagagaaggtttcagaagtaagagatgtgggggtttggtgaaactcaccagaggctgaaccctctcctgcataacacagggattgggaggagcggggtggcattaggccagatgcatagcccagtgctgctctctctggactttctgctctctctggacttgtttgctatctgagctcatccatttacataattttcagtgccatttctcagctaatgagtcctgaacttttgtcttgaggctagacttctccttcaaacagcagtcttaaacactcaacttctttcctgttttttccacttgtcaactcatgaacacctcaaccttgttacatccaaagccaaactcatggcttggagtggtaggtgatggctgtaatcccagtgctatgggaggctgaggtgggaggattacttgaggccaggagttggaagcccgcctggaaaacacagtgaggctccctatctacaaaaaaaaaaaaaaaaaagctaggcatggtgatgtgcatctgtaggatctgtagtcctgctacatggcaggctgaggcaggaggatcacttgagcccaggagtttgaggctgcaaagagctatgattgcaccaatgcactccagcctgggtgacacagccagagaccctgtcttaaaaaaaaaaaacccaaagctaaactctctttttcctcctccttctccatgggctctgtccatgccatctctgttctgtaaatggcaccaccccctgctgagctgctcaaggtggtcataactcatgtgttgtgctaactctgcttttgccctcttctccagtcagcaagtcctgtgattctaaactttatccaacttgtccagtctctgtagcttcactgtcattatctttgcctaggacaccgctatctcagctaggctacagcagcctcctaactggtcttaactggtactctgcacctgctctccatgctcagcaatccatttcctacctggcaacttcagtgatcttaaggtgtccattgagtctcatccctgcctttcctgcccatggtacatagaataaaatcgagaccccgagtcttctgcctgttcctgccacctctccagccctctcctatctcctgcccttggcctactctatttcagccgctatggcctccttttgttttcttggactttcaaacctttttccacaacacggcctttgcacttgctgcttcagcctggaatgattttcctctgcacctccccaaattagaccatcctttaggtgtcagctaaaatggtgcttccacagacagctcttccctgaccctgctcttctccaccttaacgtcttattgtttcttgttgtgggaagtcagggaccccaaatggagagggactggctggagccatggcagaggaacataaatggtgaagatttcatggacatttatcagttcccaaataatacttttataatttcttatacctgtcttttatctcttaattctgttatattcataagctaaggatgtacatcacctcaggaccactgtgataattgtgttaactgtacaaattgtaaaacatgtgtatttcaacaatatgaaatcagtgcaccttgaaaaagagaataacagcaatttttagggaacaaaggaagacatccataaggtctgcctgcctgcagggttgggcaaaaagagccatatgtttcttcttgcagagtctataaacggatgtgcaagtaggagagatatcgctaaattcttttcctagcaaggaatattaatagtaataccctgggaaaggaatgcattcctgggggaagttctataaatggccgctctgggaatgtctgtcttatgcggttgagataaggactgagatacgccctggtctcctgcagtacccaaaggcttactagggtggagaaaaactccgccctgatatatctgtggtcagcctggttctctgctcttgaaccctgttttctgttgtttaagatgtttatcaagacaatacatgcaccgctgaacatagacccttatcagtggttctgcttttgccctttgctttgtgatctttgctggacacttatcagtagttctgcttttgtcctttgtcctgttccctcagaagcacgtgatctttgttagacccttagtagtagttctgctttttgccctttgaagcatgtgacctttgtacctactccctgttcttacacccccttcccttttgaagcccttaataaaaacttgctcatctgagactcagggggcatcacggtcctactgatgtgtaatgtcacccgcagcagcccagctgtaaaattcctctttgtagtgtctctctttatttctcagctggctgacacttatggaaaatagaaagaacctacattgaaatattgggggcaggttctgcctatacttctttcatggatttacttattttttatttgtccctctgtatcctagaaactcctggagggcagatgcatgcctgccatcttcatcgtttcattaccaccatccaacactatcgggggacctgccctgataatcaggtaggttcttttctattttcctaagtgtcgagtggcttgagaaataaaaggacagagtacaaaagagagaaattgtaaagctgggcgtctggggggagacatcacacattggtaggatccgtgatgccccacaagccacaaaaaccagcaagtttttattagggagtttcaaaagtgtagagagtatatgaataggtgtgggtgacagacatcaagtacttaacagggtaatagaatatcacaaggcaagtggagacagggtgagatcacaggaccacaggacggaagtgaaattaaaattgctaatgaagttttggcaccattgtcattgataacatcttatcaggagacagggttttgagatcaacccgtctgaccaaagtttattaggcgggaattttctcttcctaataagcctgggagtgctatgggagactggagtttatttcacctctgcaatctcgaccataagagacaggtacgccatgggtggccagttccgagacctacccctaggtgcgcattctctttctcagggacgttcaatgctgagaaaaggaattcaacgatatttctcccatttgcttttgaaagaagagaaatatggtgctgttctgcccggctcaccggcggtcagagtttaaggttatctctcttattccctgaacaattgctgttatcctgttcttttttcagggtgcccacatttcatattgctcaaacacacatgctgtacaatttgtgtatgtaacgcaattattacaggtcctgagacgatatacatccttctcgactgacaggattaagagattaaagtaaagacaggcataggaaatcacaagggtattgattggggaagtgataagtgtccatgaaatcttcacaatttatgtttagagattgcagtaaagacaggcataagaaattacaaaagtattaatttggggaactaataaatgtccataaaatcttcataatccacgttcttctgtcatggcttcagccggtccctccgtttgaggtcctgacttcccgcaacatctctccctttctttttatataaatgtgccatggcgatgaaggcttgttcgttctctcgattttgacacaggattatttgactggtacggcacactaaaagcaagccgattaagcagagaaacataattccaaaatttagtacagtggatcccccaatagacttaatccataaagattttctgccacctgatctaacgcctgagctccaggcacgatggataagtgagcttgggaggcttcaaaaatttgcttttttaatttagttgttttcaatgataaattaccttttctacctagaaggtgtcctttgaccgtttcccatgaatgatcagtctcgttataggaataggggtgatgcagaaatccaaagtattccaatcgcactgcatttgcatgcgatgttctagactcactacctgatctccaagccaaataacagactgtcttaaatcattaatttgctttgccaatttttgatcgatgtcttgttgagaattccacatttgggtggaattggcttgccaatcattaacaaaatgagccgtttgaatagactggtgtaattccattccggcagtggtggccattgcagtgactgtaattaggcccatgataacagcgattaaagtgaaaacaaatctcttagatctttttagaattcgttgtaccagatcttttttgaattcgttgtaccacttcattaattaaatgtattgagggggagaattcccaaggtcgaggtaaagttatcggaatccagattctttctccagcttgaaccaacattacacttttcctggagtcaaaatgggagttaatacaagtgtatagatgacaattgacgcactggacagtttgattattcatccaaattttgatatttcctaccaatagcatgtaacgaggctcaacacaactctgtatgggaacagtcaggttggaggtaagtgaagcagaatgtctgggtctacgatgatactgagagaatgggacggtagtgggaacaacagtcaaaatagtttttccttcccatactcgcagtccagccatggcaatagccaatttccaaagttctgggtgttctgggctcagaatagggagtgtcataggaggcctggagggggcgggtaatgcctttatcttcccattttaagggaaagaatgagctgatccttctatgcaaagtagaatgatgattctctttctccggataagaaataaaataagtagcctccaggcattcccttccacagaggagcaattgttttttaaatagccctatggtgcccagtctattactaaaccatatgagtcattttttaatattactgcatgtgagttaacacaatcttcccaaattaaagttttagatggtccctcaaaatgtttagggcatggttttcctgcaggtttatattgaaagtatggggtacctcccattactcctcctttcatttgttgtaaaggagaaagggagaggccagaggccaaatgtcccattttatctgtagctgatgtttctgaaagataagcagcccagaactaagtttctagatggatgcaaccaggtgcatgtccgaggcacagaggtgggtatttataacccatggtaacattaaatgcagtgccttcttctcctggttgtgcggggcaagggtcgtctatggctccaggcatccacacactatcgttagtgtagatttctgcgggagcatctatccgggtgagagagcgaataagtggaggaaaagacacctaagcccaagaagaataattatgtgtagcaggtaaatcagtgtgagaggaaactggtgagacagaaagtataaggaggagaatcattaaataaaacctagtgtaagcgagatggagtgctgaaggagaaagagaagaagagtgggatgttattttcaggctaatagaaatggtgagatatttaggtttgtaaggagaaaaagaaaggtaatcaggataagtgtgattagttagatgggtctccactgtcatcagggaggattgatttacacccattgtgatttggtgtgcctgtttctgaggagtcggcacagatctcaccacatctgaaggcagtctctgacacagacgtctcttcactgtggttttgattgtcagtattcacaagaagcttgagtcttctggtgggcacccagacaggggattgatgatctcctggtgaaacacaagcatatcctcttccccacgttaagtagaataagagacaatatttaaaggtttggggaaatcctgtaaggcagtaatcacagcaattaactccgcattttgaagagaagtataagaggtagaaagaagtttgtctgcaggacctgtatagccagcattgccattaccagagccatcagtgaatactgtaacggcctcaggaatgggttgatttttggttaatctaggaaccacccaagacgttatttttataaaatcaaacaatttgtttttttggataatgatcgtcaataacaccaataaaatcagccaagtgaatttgccacagtacagaatgttgaaaggcagcttgaacttcgagctgatttaaaggaactacaattacacttggatcaaatccagaaaattgaagtattctgcaccgaacctgtccaattaatatggctatttggtctagataaagtttttgacacagaatgaggaagaaaacaccattccactaaatcattatgttgaactattagtccagtaggagagtgtaatgaagcaaaaaccagaagctgaaaaggctgaaatgtctgtactctagataactgggcggtctggatttcttcctctacaaattccagatccagtaaagcctcaggggtcaaagtcctagggctgcggagatcagaatctccccgcagcatagagaacaagttagacagggtataggtcggaatgcctaaagtaggtcttaaataattaatgttacccaaaagtttttggaagtcatttaaagtttttaaagaatctctcctaatttgaactttttgaggttgaatacattgtttatcgaccaccattcctaaatattgaacaggagtggtctgttgaattttatcctgagcaatgcgtaatccagcctctgtaacacagcggttcaaaatttggtaacagtcaattaattttttatcagtgggggcagaaattaaaatatcatcaatataatgaagaatataggcctcgggaaatcgggctcaaactggtgaaagcacttgtccaacataaagctggcagattgtagggctatttagcattccctgaggaagtactttccattgataacgagctacaggctcctgattattgatagatggtacagtaaaagcaaatttttcacaatccgatttatgtaaagcgatatgaaaaaaaaaacctctttaagatcaataagtatgagaggccaatctttaggtattaaagcaggggcaggcatgccgggttggacggcccctataggtttaattacagcattaatggcccttaaatcggttaccatccgccatttgcctgatttcttttttactagaaacacaggagaattacaaggggaaagagaaggttccacatttccaagttgtaactgctcagaaaccaattgatttaaagcctccagtttttctttagaaagcggccactgctgaatcccagggccacttgtcttatctcctttgtttaaaaggatattaggtagtaaaagcaattgaacttgtttaacagtagtaaaagaaacaagagcttgggctcgggagtgtagtttatcccaagctctcatacacacttttgttacttgttttgtggtaagagtatcaaagtttaattgggcataagcatcagagaaactatcggagcctgtgagctgagcctgagtaattagaatgccattactccgatttagctgagcctgtaaacaggcctcctctgaccaccaggctgagatggacttagaacagctttttgccaaaagatcacagtctaaaggaagcaaaacaacctcagtataaaaagtttgcaataccatttgaacataaggaaaagtaggaccatactgagtacaagcatccttaaattgtttttaaaaaggtaagattgagcggcgcctatcgatgcagactggctgaggaactgaaacgacaggagggtgaggggctgtagtggatgggggagggcctggagaatgacaggtaaattgtagtttggtcccagagccattatttgatgctggaggtttgaagagagaagaattagcatatttatgttaccgggctttgtgagtcacagccgcaggagtgtgaagtaccggcttttcgtgggaagaagtaagaaaagtagggggtaactttaagccaaagttaccagagttagaaatcgaattttcagaatcgttagggaggggaggagtagctgaagggagagtctgaacgaaggccatgtgggagaggaaggttgagaaaaaggcagagaaactgaggaaaaggcagaaaactgcggcaactgcagggggtcacgagattggcaagccacgaagatgtcacgcaccaagcaccccaaacagtgatgggcacataatacccggccgagatcagttttcggaatgccttacggacacaatcacacaattttatatacaccgttcctttttcaggaaaccaagaacagtatttttctactgccctgaatagagtgatcatatttttcatggttaccggttttaacaggagtttgttagattacacatgacccacagttaacccagaccttacacagattactcaccactcgtcggggagttgaacacgcttatctgtggaccaagccgattgacgtttcaccgcacctaccaaagggaatccggttccctcatgcacttaggaaaaaagaaagaccacgtgggcgccagatatcgggggacctgccccgataatcacgtaggttcttttctattttcctaagcgtcgactggcttgagaaataaaaggacagagtacaaaagagagaaattgtaaagctgggcatctgggggagacatcacacattggtaggatccgtgatgccccacaagccacaaaaaccagcaagtttttattagggagtttcaaaaggggagggagtatatgaataggtgtgggtgacagacatcaagtacttcacagggtaatagaatatcacaaggcaagtggagacagggccagaccacaggacggaagtgaaattaaaattgctaatgaagttttggcaccattgtcattgataacatcttatgaggagacagggttttgagatcaacccgtctgaccaaagtttattaggcgggaattttctcttcctaataagcctgggagtgctatgggagactggagtttatttcacctctgcaatctcgaccataagagacaggtatgccccggggggccagttcagagacctacccctaggtgcgcattctctttctcagggacgttccatgctgagaaaaggaattcaacgatatttctcccatttgcttttgaaagaagagaaatatggttctgttctgcccggctcaccgggcggtcagagtttaaggttatctctcttattccctgaacaattgctgttatccggttcttttttcagggtgcccacatttcatattgctcaaacacacatgctgtacaatttgtgtacttaacgcaattattacaggtcctgagacgatatacatccttctcgactgacaggattaagagattaaagtaatgacaggcataggaaatcacaagggtattgattggggaagtgataagtgtccatgaaatctttacaatttatgtttagagattgcagtaaaggcaggcataagaaattacaaaagtattaatttggggaactaataaatgtccataaaatcttcataatccacgttcttctgtcatggcttcagctggtccctccgtttggggtccctgacttcccgcaacacagcacagtgcctggcacaaaagagttgctcaataaatacatcaggatgaatagataaatacatggataggcactttgaactacagatgagcttaaatactttgtgtttttcttagtcaaacatgtgcaattaagcatgtgataaatgttatgatgagcatacctgtgtcttgcctgatgttctttgcaatcactaaatgaagtcaattgggcctgttttgacagttctattttcaacctaatgatctgtttattttaacttctggctgttggctttgtttgggtttgttagcctgacaaagtggtagatattggtatttgctcttttgtttaaatgtcacgaactttaaaaatgcctttgcttttggtaagaaaccctagttaggacaccctagcagtcaggatgatttgcgttctggtgctgtaacaacaatccccaaatctcagtggcctcatgcagtgaggtatttgtttgtttgtttttgagacagggtctcactctgtcacccagactagagtgcagtggtgcaatctcagctcactgcaacctctgcctcccagactcaagtgattctcctgcctcctgagtagctgggattacaggcccatgccatcactgtctggctaatttttgtacttagtagagacagtatttcaccatgttagccaggttggtcttgaactcctgacctcaaatgatccacccgccttggcctcccaaagtgctgggatgacaggcatgagccaccatgtctggccacagtgaggcttattcttggtcacgttgcatgtctgggctgtgttagggcattgtggggtggtctgttcattgtgttcactcagggatccaggctgacaaaagccccatctctgcatgtgtccttgatcaccacttcaggggaaagagaatgtggtggatcatagagcctcttaacacttccacctggaggtgactcaagttgctcctgctcatggttcattggacaaaacagatcaaagagtcatgggcaacttctctgtgcctggaagaggaaccaaaatatgaatatctacattgactttccctagctattacacagaaggtctcatttaaatgcagttacttatttgtgttttgaagctaactgtagtccatcaaacttcacagaagatatgtgcacttccaagctattactaagcacaattttttttttttttttttttttttttttttttttttttttgagacagagtctcactctcttgcccaggctggagtgcagtggcatgatcatggataacagcaacttctgcctcctgggttcaagtgattttcatgcctcagcctcccaaagtgctgggactacagacaaccaccaccgcacctggctaagttttgtatttttagtagggatggggtttcaccatgttggcctggctggtctggaactcctgacctcaggtgatccacctgtctcagcctcccaaagtgctgagatgacaggcgtgagccgctgtgcccggccttgagtatgatttttgattgggaaggtcagagttagggttttagtctgaggacagtatgatgtgaaggtgaaaagcagagcttggctgtgagtttgctgggattcctgtgctgcttctacagctctttggctgtgtgaccatcacctttggcaagttcctttacctttctatgtgttggcttcctcatcaataaaatggaaaaactaatcataatcatagtatctgttggtgttgggatagcccagtggttgacacataaggactcaaaaatagttttttttagtttttttttttttttttttttttgagacagagtcttgctctgttgccaggctgtagtgcagtggtgcaatctcagctcactgcaaactctgcctcctgggttcaagcgattctcctgcctcagcctccctagtagctgggattacagacacctgccaccactcccagctaatttttgtatttttagtagagatggggtttcaccatgttgtccaggatgctcttgacctcatgatctgcccacctcagcctcccaaagtgttggaattacaggcatgaaccaccgtgcccggctcaaaaatactattactaattttggggggtagttactatattttgtgaaaatcagagttcagtaccttgtaacactgggttgggatctatccctgaaggaacaggcttcttaagaggaaggcatggagtgaggggcaaaattttagttgatgttgtaatgactttaggtatatggatctgggtctgagttctagctggggccaccaggtagcaaggtgaactttgctaaattctatcactttcctgagcctcagactcacttgttacaaatgaggttaaagcatccctctttcagggctaagataaagatgattaagtaagagggaatgaaagtaacttccatcaatggtcaaaagtattcgtttaaaaaaaaaaatatatatatatatatatatttttgagatggagtctctctctgttgcccaggttggagtgcagtgacatggtcccgggtcactgcaacctccgcctcctgggttcaagtgattctcctgcctcagcctcctaagtagctgggattacaggtgtgtgccaccacgcctggctaatttttgtatttttagtagagacggggtttcaccatgttggccaggatggtctccatctcttgaccttgtgatccacccaccttagcctcccaaagtgttgggattacaggcatgagccaccacgtccggcccatttaacttctatattactttcctgttggtggatttaccagtgcaaactgagcagcttaaaacaccaccaagggtctgggcagggtttaactgggtcctctattcagggtcacaatactgcaaccagagtgtcagttggagctggggtctcatgggatgctcagtatcctcttccaagcttattcagtttgtggactgaattcaatatcttgcaattgttgaatgaaggccctcaactcctagagctgccacctccaaagacagctcacagcatggccatttgtgtctccttggaggctaagggttgaacctctgaaacttcacctttaaaagattcacctgattaggtctggcccacctaagatcatcctgctttggatgaactcaaagtcagctgaacaaatgtgcttaacaaagcaactgtgaccataatcacatttgcaaaattccttcctcttggccaaatcacaagctctgcacacactcaagaagaggagatgatacagggagcagatataagggagtgggtctcttgggggctgtcttagtattctgtccattacaacttcctttcttgaggaacagcaggcctggggagagatgatcacagatgagggcagcccacaggtggtgagagcctggtgctggtgtaggatgcaggaggctgtgaagcaagtaggaaaagccttctctgggctgggtgcagtggcttacacctgtaatcccagcactttgggaggctgaggtgggcagatcacgaggtcaagggatcgagactattctggccaaccaacatggtgaaaccccgtctttactaaaaataaaaaaattagctgggcatggtggcgcatgtctctaacaacccagctccccaagtgagcaactcttgtcccttttaagggctcacaaatctaagggagtccacatgagagggtcatgatcgattgaccaagcagggagtacgtgactgggggctgcattcagcaaaccccatctctactaaaaataccaaaattcagcaaagtttcaggatacaaaatcagtgtgcaaaaatcacaggcattcttatacaccaataacagagagccaaatcatgagtgagctcccattcacaattgcttcaaagagaataaaatacttaggaatctaacttaccagggacatgaaggacctcttcaaggagaactacaaaccactgctcaatgaaataaaagaggatacaaacaaatggaagaacattccatgctcatgggtaggaagaatcagtatcgtgaaaatggccatactgcccaaggtaatttatagattcaatgccatccccctcaagttaccaatgactttcttcacagaattggaaaaaactactttaaagttcatatggagtcaaaaaagatcctgcattgtcaagtcaatcctaagccaaaagaacaaagctggaggcatcacgctacctaactttaaactatactacaagacaacagtaaccaaaacaacatggtactggtacaaaaacagacatatagacaaatggaacagaacagagccctcataaataatgctacacatctacagctatctgatctttaacaaacctgacaaaaacgagaaatggggaaaggattccctatttaataaatggtgctgggaaaactggctacccatatgaagaaaactgcaactggatcccttccttaccccttatactaacattaattcaagatggattaaagacttaaatgttagacctaaaactataaaaaccctagaagaaaacctcagcaataccattcaggacataggcatgggcaaggacttcatgtctaaatcaccaaaagcaatggcaacaaaagccaaaattgacaaatgggatctaattaaactaaagagcttctgcacagcaaaagaaactaccattagagtgaacaggcaacctacagaatgggagaaaatttttgcaatctactcatctgacaaagggacctatgactttcttataaccaagagaatatggcagaggtgacaggatgtagtgattatgttagatagataggatgttaagttgtcttgctaggaggctgtctgtcttgctggctttgaagatgtgagctgccatgtcatgagcggccagatggagaggcccatgtggcaagaagctgatggcagcaagaaactggggccctgagtccagcagcctgcaaggaactgaatgctgccaacaaccagatgagcctggaagcagatcaatcaccagtcaagcctccagatgagaactgagccctggctgacactatggccacaggcttgcattgaacccagctgagtcacacctggatttctaatccacagaaaccgtgcagtggtaactgtttgctgtctcaagccacaaagtttgcagtaatatttttgcacagcaatagataactaatataaaaactgtcctacatcatgtacattactgagcgaaaagtagaacctggatttgagctctgatttcagagttgtctccccagggagacctgtcctgggagacagttatgccaggctgtgatgctgtgatgattgttctcttcctactcagaagctttcaataggcatgtcaagcatgtgaacccagctacatataccaaatatatttctgacaaatgccaggacatcgtgagctttcttattttactgagagctccctaaaggagggaccatctctgtcttttttttttttttaatagtctcactctcacccagactggagtgcaatggtgcgatctcggctcactgcagtctctgcctcctgggctcaagggattctccagcctcagcctcctgagtagctgggatcaaaggtgtacatcaccacacccagctaatttcatatttttggtagcgatggggttttgtcatgttggtcaggcagatctcgaactcctggcctcaagtgattcgcccaccttggcttcccaaagtgctgggattacaggcatgagccactgcacctggcctgtcttttttatgttatgtccacgtgaaacagcccagtggtcagcacacaaaggggtccaaatgtgaaagggcaaacacaggggaaacaggggtgttcagaaatagttcccaggttactgtctgtttcaatatgtaccgttctctgccccacccacaagattctgacttggcgggtcagagttggagatgggggagctacctggttacgagggatcccagtgattttgaggcagctggttgttagactgcactgtaaaagttaccccccaaagatgtgaagggataattcatgtatttttaatagagatagggtttcaccatgttggccaggcaggtctccaactcccagcctcaggtgatccgcccgccttggcctcccaaagtgctgggactacaggcatgagccattgctccaagcactatttttttaatgaggccaaatacacataacatacaagtccctgtatgaaatcatacacttcagtatcattaaataccttcacaatgttaagcaatcatcatctctgtctagttccaaaacattttctttaacaccccccgccccccaaaaaataaccctgtatccatcaagcactctccatcccctcccctttcccccagttcctggcaaccacttacctgctttctgcctctacagatttgcgtattctggacctttcacataaatggaatcatgtaatatatataataaccaaaaggtagcaacaacaaagatggtcattcggtttatgaatgaataaacaaaatgtgctgtatccgtacaatggaagtattggtgcctactacatgtggatggaacttggaaacatcacgctgagtgagagagagccttggtattgtctcatctccccaggagattccaaggtgcagccaaggttgagacccactgacaagcaatggataaggttgggtgcagatgaaataaggcagccaggggcaggagggacgtctcattgaagacgactatttgtggatgcctagcaggggtggggatgagggatgataacagcaaccccaatcccaacacagcgtgaccgattttatcttcagccagctgatacgcctcatggggtgtggacacaggacatctctgcctcccaggttcaagcgataactcctgcctcagcctcctaagtagctggggttacaggcatgtaccaccacgcctggctaatttttgtatttttagtagaaacgaggccttttcatgtggcccaggttggtctcgaccttctggcctcaaatgatccacccacctcagcctcccaaagtactgggattacaggcatgagccacagtggcagcctccaaattctatttgaagttcgactttccacctccagaaaatccaaacctttgcccaagtcacagtgggacacctcggagttaatgtgagagaaatgtgcttttaaaaacaactccaggactagcacagtggctcacgcctataatcctagcactttgggaggccgaggcggacggatcacgaggtcaggagatcaagaccgtcctggctaacacggtgaaaccccgtctctactaaaaatacaaaaaattagccgggcgtggtggtacatgcctcgaagcccagctactcgggaggctgaggcaggagaatcgcttgaaccagggagtcagaggttgcagtgagccgagagtgcgccactgcactctagcctggtgacagagagagattccgtctcagaataaataaaaccctccgatatgaacaccaaactagaatcactccattgacttccctccgccaatcagggggagtgatggtgatggtgcatgagtgtctatttgcattcagtctcactcaaaggaaaaacaaatcacagcccagactggagctgtggatgaataacatggctgagtgttggtacaggctttccacagcaatactaaaactgaaaaaatcagcaatgaaactcccagccacatttctgccaaatgatttgggggaaaacaacagaggcactcctcaactttttcttcgctgcacaaagtgggtttggctggaaatgccaagtgtgcttgttgctgggatctttcaaatgaaagcaagctgggagtcaaactcctgcagccacaggccagaaatgggtttagagcaaactattatagtaacactggtgcacatcgaaacagattaaactccctcacagcaatccagattaattgaatatgctttcttattggcatactgcgtttctcattaaagcaaatgaacatccatccctctataataaattagggccaaaaaaaattcatatgtttagggcatagggaaggaggagttgttggctgttaaaaaaaaaaatactgcaagtggcctttgaaagtctagacatcttcatcataaacacaaatattcctcttcacaaagggacctcaagtaaccttaggctggagggcccacttgagtatgtttttcttctcattctttcttaccttccctccagcccacccaacccacattcagtgaccaagtcacgtgggttttacctcctaaatcttttcagatccgttcactgctcagccactctcctgacaccaccataaaccaagccaccatcacttccagctgtttgactgcaaatgcctcctcactggcctctgtcttcccctggccctgtgacaatctgcactcctcacagggaccaaagcaatcacttcagaaggtgcatccaaacagatcactcactttcaatggctcccactgctctatgggttaacaatgataaaagctcagccgggcacgggggctcacgcctgtaatcccagcactttgggaggccgaggcgggtggatcacgacgttaggagattcagaccattctcgctaacacggtgaaaccccgtctctactaaaaatattaaaaaaattagccaggcgtggtggcgggcgcctgtagtcccagctactcgggaggctgaggcaggagaatggcgtgaacccgggaggcggaggttgcagtgagccgagatagcgccactgcactccagcctgggcgacagagtgagactccatctcaaaacaaacaaacaaaaaacaatgatcaaagctcacctttacttagcacactctatcgcagtccatccctacatcacccttgatttcacgagtggggaagctgggacaaagagtagttacgtgggatgcccaaggtgggaccactcgtatgaagtttccacacactaatgtgagaccctccatgacctagcccctctctttctccagcctcatttcctgattctttcgcttgccctgcaggcttcagccacacaaacttcttgaaagtcccttaaatctggctgagcgcagtggctcacgtctgtaatcccagtactttgggaagctgaggcgggtggatcacctggcatcaggagttcgagaccagcctggtcaacatggtgaaaccccatctctactaaacatccaaaaattagccaggtgtggtagagggcgcctgtaatcccagctactagggagactgaggcaggaaaatcgcttgaactcaggaggcagaagttgcagtgagccaagatcacaccactccactccagcctgggcgtcaagactgaaagtccgtctcaaaaaaaagtcccttaaatctgctctatgcctatcaacctcagggacttcactatgctgttcctcaccctgaaatgctgttcctcatttctctacatagcgaactcatcccaccccctaggtctctccttaagtgtcatctcttcaaggaagattttacttttttaatataactattaaaatataattcaggtaccgtatgatttgcccatttaaagtgaacaaatcaatggtttcagtgcattcacagaggtcggcaaccaccatcatgatcaattttaaaacattctcatcaccccaaaaggaaaccctgtatccatgagcaggttcctgccatttcctcctcccactaagccctgacaatctactttttttgagatagagtctctgtcaccggctggagtgcagtggcacaatctcggctcactgcaacctccgcctcccgggttcaagcaattctcctgcctcccgagtagctgggattacagggatatgccaccatgcccatctaattttgtatttttagtagagacagggtttctgtcttcatagctttgcgtgttctggacatttcatataaatgaaatcttataatatgtgaccttttgtgactggtttcttccacttagcttaatattctcatagttcatccgtgttgtagcacgtgttagtacttcattccttttgatgactgaataatattccattgcttggtcaaaccatgttctatttctttactcatcagtagacaagcatttgtgttgttttcactttggcgctattatgaataatgctgctgtgagcatttgtgtacaagtttctgcagggacatatattttcatttcttccataaactggagtggaagtgctgggtcatagaactctgtgttcaagcttttgaagaagtgccagactgtgtaataaagaaagcctttcctcaccctgtaagaccgagctccctctctccatttatacgttctctttatgccctttgcttctctttcagagcaattcacgatgagctgggtcaccctcaacttaaggctcataactcccttagaccctcagggtccacactaaatatgatgaaatatgatgcaagccacatatttacttttgcattttgtagtaaccacattttaaaaaggaaaacaaaagaagtgaaggtaactggaataatatcacagatttaaacaaatctatccaaaataccaggtctacaaatataaaatattttaacattaacaaaatattttgctttctttttatatttaggcttcacaatctaatgtgtatttgacacttctcacacatctcagtatgatggcagcacccatatgggaggccctcccatgatgccaatgatgggcccttctcctcctgggatgatgccagtgggacctgctcctggaatgaggccgcccatgggaggccacatgcccgtgatgcctgggtgcccaatgatgagacctcctgcctatctcatgatggtgcccagtcagcccagaatgactcgaccagacagataaggatagaggggagggctcattacatcagtgttgcttttttggtgttattgttgtgcgtttttttgttttgttttgtttttgagacagagtcttcctccgtcacccaggctggaaggcagtggcacgatctcagctcactgaaacctccacttcctggtttcaagtgattcccctgcctcagcctcctgagtagtgtgggactacaggcatgtgcaccatgcctggctaattttttttattttagtagagacagggtttcaccatgttggccaggatggtctcaatctcctgtcctcgtcacccgcttgcctcagcctcccaaagtgctgggattacaggtgtgagccactgcgcccggcctgtatgagttttatatttacctgctcccttcaccaggagatcgtgccgctgtgatgctggcttttcttaacagcataaggaagacttgcccccttgccccatcaaagagaatagttttggaggggagaagtgggaccaaaaaagatgcagttttcatttgtattgggaaatgtgaaaatagaattgtcaactcttttagttaaaaacgaaaaaaaaagaaaaggaaacaagatgtggggctgccataagcaataccatggattccaaggatcttctactctggagggaaatattatctttgctgaagccagaccaacctgacacaaagaccttttggttttttaatgtgactgtgttttattttacaatgtgtaattcactttagaagggcaaagtacctgtctggggaagactatttaatttcctgcatttatttagaatgttggctgatgttgttatgaaaggaaacagctctaacaactgagtgccccccacatagccacagctcatgagttcatggggcaaaggaattgaacagcagcctcctaatagccggccttctttgtggtatggaaatgattatcaacatgtaaaagactatatatatattcaacaattctgaccccctgcaaaattcaaatccacaactgatttgcttcctgggctcctgaaaacaactttgtcaaaattgtttagaaataaaatcagccaattgttgccccttggggatgcaggacaaagcaagtcagccatgaccaatgtggagtcggccgtacacaattacatgcagacctgcaggacatcgagtctctgctatggtccctccccagtcaggcccccattgcctgggctgcagccagaaggattcaggcacaagtgcattcaacaaatatttaattgcattggtggttagagggttgcggttgattaaggtacattaatggatccatgtcctccctgtatccaagactctgccatttgtctctgcagttcctcccactgaagaatcggagtatatttctccagcccctaatgttgggtttagtcatgtgtctagctttggccactggaatattaacctgcatgaccaaaaacttggaaagtgtgcattcatttgtgctcgctcactcctgctatcaccatgagaacaagcccaggccagactgctgcttccagcagaagataagagacaccaagagcgaagtcgagcctctgagacatgctcatgccagattaaccaatcctcagctgatccataggtccatgaaaataaatgattgttgtattatgccactgagatttggagtgacttgttatgcagcattttgtgacaacaactaactgatacaagggtcaccgtcctttatcgctgtagattttaaccaatttttaatagctagatggagatcttctagttgcctttatttataatgaatatgactgtagagctagtttggcctgatactaccagtaacctacccagaaattcagaaatactttcttctccaacccaccccaaccaaccttttttttattttgttttgtttttgggttctccatctttgcctaggctagagtacaagtggtacagtcagagatcactgtaacctcaaaatcctgagctcaagtgatcttccccttcagcctcctatgtagctaagactacagacatgtgccaccgtgcctggctaatttttttattctttgcagagacagggtctcactatattgcccaagttggtttcaagctcctggcctcaagcactcctcttgcctcaccctcccaaagtgctacgattatagacatgagccaccacaccagcctcttcttctttttaaatagaaaccctattttattctgacagtaggttgctttttttttttttaagaaaaatttggcccagccccagggaataaattgtgactggtctaaacagggttggcaaactatagaccaagggccaaatctggccctctgactgttggtataaattaagttttattggaataaaaccaggtccattcatttatgcattttttacatatgcttttaggctacaatggcaccactgggtcactgcaacagaggttatctagaccaaaagcctaaaatattactgtttgcctctttatggaaaaagtttgccattccctagtctaaggtttagattctgagcttatcattttagcctatccccccttaccagtgactggctcaaaacaagtctgtgattccattctgaatgttctactgagggaattctcccttcttctcatgcagagttgatgaggacaagttgtattaataggacatatgctcaggttttctgaaaaatacttttatctagaaatgcataggaatatgctggtgcctgaatgtaccatccgggggcctggagattgactcacctgcctccagagctagtgctcacccttactactgagaggcctgaggaaacacctgcctacccaccaccagaacctgcacagatcacctggagaactagagatcagactgccacacacaccacccaggagcccagtggtgcacctgcccaactggcccagtgctgccactgccagcaaccaaagaagccacctggaggcccagggattggcccatgcagacaggctatcatcagtgcccatgtatactgcctgtggtccctagtattgacaaacctggtccaccaccactaccactgaggctgaaggacaagacttcctggcatccccatcctcagcaaagcctcaccacagcttccaataacaactgcattctggccaggtgtggtggctcacgcctgtaatcccagcactttgagaggccgaggtgggtagatcacgaggtcaggagtttgagactagcctggccaacatggtgacaccccgtctctactaaaagtacaaaaattagctgggcatggttgcacgtgcctgtactcccagctactcaagaggctgaggcaggagaatcatttgaacccaggaggcagaggttgcagtgagctgagattgcatcactgaactccagcctggtgatagagctagactccatctcaacaaccacaaaaaaaaaaaaaaaaaacaaaaccaaacaaaaactacagtctaagccactgaatgactcacagacaccactcatccaattacagcagaagaaatcatatgcagattataccactgtacccacccagaatcaaagccaaactgtgatatccaatgaacattgtagatatagctataagaaaaggtctttcccatataaaagccaatccataaaattggaagcagtgactgttatgtcagaggcacagatagtcacataaggatgcaagaaatatgaaaaaggaaacataacatctccaaagaagcacaataattctccagcaacagattccaatgaaaagaaaatctatgaaatgcctgaaaaaaattcagaataatgttattgaagaaactcagggagatacaagagaacacagataatgaatacaaaaaaatcaggaaaacaattcatgatctgaatgagaaattcaacagagatagacagcgtaacacagaaacaaacacaaatcctggaagagaataaatcattgaaagaaatacaaaagataattgacagctttaacaatagactagatcaagcaaaacaaagaatttctgaacctgaagactagtcttttaaaataatccagtcagacaaaaagaaagaaaaaagaatgaagcaaagctacatgacatatgggacacctatgtgaccaaaaactgaaattctgggagttctggatggagatgagatgggtaaaggcatagcaaacctatttaataaaataataactgaaaacttcctgaaagcttcaaatacaggaagctgaaagattaccaaataaatacaactcaaaaaggtcttctccaagacacattatggtaaaattgtcaaaagacaaacagaaaatgctaaaaacagcaagagaaaagcaacaagtcacttataagagaatccccatcaggctaacgagatttctcagcagaaaccttacaggctaggagaaaaggggatgtatactacaagttaaaaaaaaaaagtaagccaaaaatactatacccagcaaagctatccttcacaaatgaaggagcctggcacagtggctcacatctgtaatttcagagactcataaggctgaggcaggaggatcatttgagcccaagagttcaaggctgcagtgagctatgatcatgccactgtactccagcctgggtgacagagtgagactccattgctaaaaataaataaacaaataaataaaagagaaaaaagtatttctcagataagtaaaagactgtttgtttgggtattgtttgttgtggtcatacaagaaatgcttaagggagtcctacattgggaagaaaaagaacaatatctaccatcatgaaaacacatgaaagtataaaactcactggtagagcagacacacaaagaagaaaggattcaaacatcaccactaaggagagaaaataggaataaaggtgtattagtctgtttccacactgctgataaagacatacctgactgagactgggcaatttacaaaagaaagaggtttaatggacttacacttccacatagctgaggaaacctcacaatcacgttggaaggcaagaagaagcaagtcatgtctcacatggatggtaacaggcaaagagagagcttctgcagggaaactgccctttttaaaacaatcagaacttgtgagacgtattcactatcatgagaacagcatgggaaagacctgcccccatgactaaattgcttcccaacaggtccctcccacaacatgtgggaattcaagatgagattttggtggggacaaaaccaaaccatatcattctgtccctggcccttcccaagtctcatatcctcatatttcaaaaccaatcatgccttcccaacagtcccccaaactcttaactaagttcagcattaactcaaaagtccactgtccaaagtctcatgtgagacaagccaaatcccttccacctatgagcacataaaatcaaaaacaagttagttacttcctagatacaatgggggtataggcattgggtaaacacagtcattcctaatgggagaaaattgccaaaacaaaggggctacaggcgccatgcaagcccaaaatccagtggggcagtcaaatctcaaagctccaaaatgatctcctttgactccatgtctcacatgcaggtcatgctgatgtaagaagtgggctcccatgaccttgggagaaaaaaggccacagctccactcctgtggctttgtagggtataaaccccctcctagctccttccatgggttggcattgagtgtctgccgcttttccaggcacacagtgcaagctgtcagtgaatccactattctggggtctggaggatggtggccctcttctcacagctccactaggtggcgcagcagtagggactgtatgtgggggctccgaccccacatttcccttccgcactgccccagtagaggttctccatgagtgccctgcccctgcagcaaactcctgcctggacgtctaggcatttccatacatcttctgatatctaggcagtggttcccaaacctcaatttttgacttctgtgcacccataggctcaacactatgtggaagctgctaaggcttgggacttgcaccctctgaagccacagcccacattgtacctaggcaccttttagctgcagctggagtggctaggactcaggcaccctaggctgctcacagcaggggggccctgggtccagcacacaaaaccatcttttcttcccaggcctctgggcctttgatgggaggggctgccatgaagatctgtgacatgccctgaagacattttccccattgtcttggggatccacatttgactccttgttacctaaacaaacttctgcagccagatcgaatttttcttgagaaaatgggattttcttttctattgcatgttcaggctgcaaattttccaaactttcatgctctgcttcccttataaaactgagggcctttaacacacctaagtcatctcttgaatgctttgctgcttagaaatttcttctaccagacaccctaaatcatctctctcaagttcaaagttccacaaatctctacagcaggggcaaaaagccaccagtctctttgctaaaacataacaggagtcacctttgtgccagttcctgacaagttcctcatttccgtctgtgacaacctaagcctagactttattgtccatataaccatcagcattttgggcaagtctctaggaaatctcttccaaattttcccacattttcctgtctccttctgagccctccaaactgttccaacctctgcctgtttcccagttccaaagtcacttccacatattcaggtatcttttagccacaccccacttctggtactaatttactgtattagtccattttcacacagctgataaagacacattcaagactgggaaatttacaaaagaaagaggtttaatggacttacaattctacattgctggggaggcttcgaaatcattgcagaagtcaaggagaggaaagtcacatcttacagggatggcagcaggcaaagagagagattgagcagggaaactactccttttaaaaccatcagatctcaagagacttattcactatcaaaagaatagcatgggaaatacctgcctccatgattcaactacttcccactggatccctcccacaacacatgggaattcaagatgagatctgagtggggacacagccaaaccatatcaaaaggatatacaaaataaccagaaaacaatgaacaaaatgacaggaataagtcctcacctatcaataataacttcaaatatgtgttaagttaactacctaaaagatagaggcaggcttaatggacaaaaaatgacccaacaacgtctacaagaaactcatttcacttgtaaagacacacacagactgaaagtgaagggattgaaaaagatataccacataaacagaaatcaaaagtaaccaggagtagctaaacttacatcagataaaacagactttaagtcaaaaactgtaaaaaggacaaagaaggtcattatatggtaataaagggatccattcagcaagaaagtataacaattctaaatatgcatgcaaccaacaaaagcacatccagacacacatagcaaatattattaaatctacagggagagatagaatccaatacaatgatagttgagaacttcaatatcctactctcagcattggacagttcatctagacataaaatcaacaaagaaacattagatttaagctgcactttagaccaaatggacctaacagatattttcagaatatttcatccagcagcagcagaatatacaatcatctcatcaacacatggaacattctccaggatagaccatatgttaggacacaaaacaaggctcaacaaaattttaaaaattaaaatcatatcaagtatcttctcagaccacaatggaataaaacttgaaatcaataagaagaagaaatttggaaactgtacaaatacatggacattaaacatgctatcgaatggtcattggagcaatgaagaaactaagatggacatcaaattttttttttttaaacagaaaatagaaacacatcatgcaaaacctatgggatacagcaaaagcactactaggaggcaagttcatagcaataaatgcctacaccaaaaaagtagaaagatttcaaataaacaacctaacgatgaacctcaaggaactcaaaaagcaagaacaaaccaaacacacaattagtagaaagaaaagataataaattacatagcagaaccaaatgcaacggagacaaaaaagaaatgcaaagaatcaacaagataaaagttggttttttgaaaagttaaacaaaattgataaaccactagtgaggctaacaaaaaaaaaaaaaaaaagagagagacccaagtaaatacaatcagaaatgaaaaaggagacattacatctgttaccaaagaaataaaaaggatcattagaggctattaggaacaaccatatgctaacagattggaaaacctagaggaaagggataaattcccagaaatacacagcctaccaagattgaactaggaagaaacagaaaacctgaactgagccaaaatgaatagcaggtttgaatcagtaacaaaaagtctccccaaagagaaaagccctagactaggcttttatgctgatttctacccaatttataaagaaaaacaacaccaattcttctcaaactattctcaaaaattgaagaggagggaattcttcctaactcattgtataaggccagcattaccctgatatccaatcaagacaaggacacaacaaaaagagaaaactacaggccaatattcctaatgaacacagatgcaaaaattctcagcataatactaccaagccaaatctgatgatgaatgaaaaagataatataccatgatcaagtgggatttatcccaggaatgcaaagatggctcaacatccagaaattagtgcatgtgatacatcacatcaacaagatgaaaggcaaaaactatctgatcatctcagcagatgcagaaaaatcactcagtaaaacttaccattccttcatgatgaaaactctcaacaagttatgcatagaaggaacatttcaacataagaaaagcatatatgactaatctacagctaacatcctactcactgggaaaaattgaaaagcctttcctctaagaactggaataagacaaggatgcccactttcaccactcttattcaacacagtatgggacatccaagccaaagtgatcagacaagataaagaaataaaaggcatccaaaatggacaagaggaagtcaaattgtctcactttgcagatgacataatcttatacttgtaaacagaaaaacctaaagactccaccaaaaaactcttaaaatgggtaaattaggctgggcatggtagcttatgcctgtaatcccagcactttgggaggccaaggtgggcgaatcacctgaggttgggagtttgagaccagcctggccaacatggcgaaaccctgtctctacaaaaaatacaattagcaaagcatggtggtaggtgtctgtaatcccagctacttgggaggctgaagcaggagaattgcttgaacccgagaggcggaggttgcactgagccaagattgcaccactacactccagcctgggcaacagagtgagactctatctcaaaaaataaaaaataaaaaataaaaaaaatttaaaaagcagatgtataattcagtaaagcttcaggtcacaaaatcaacctagaaaaatcagtaatgtttctatataccagtaagaaactagctaaaatagaaatcaaagaagaaattctatttacaatagctacaaaaataaaatacctaggaataaacttaaccaaggagggggaaaataaaccaaaaaacctctgcagtgaaaaccacaaaacattgataaaataaattgagaaggacaggaacatatggaaaggcatctcatactcgtgggttggaataactaatactgttaaaatgaccatgctactcgaagcagtttagagatttagtataatccctatcaattatattattcacagaaacaggaaaaaaaaaagccctgaaattcatatggaaccacagaagacccgaaatagccaaagcaatactgagcaaaaagaacaaagctagaagcctcacactacctgatttaaaaatatactgcaaagcggccgggcgcggtggctcatgcctgtaatcccagcactttgggaggctgaagcgggtggatcacaaggtcaggagatcgagaacatcctggctaacatggtgaaaccctgtctctactaaaaaaaaaaaaaaaaaaaaaaaaaattaccaggtgtggtgatgggtgcctttagtcccagctactcgggaggctgaggcaggagaatggcgtgaaccctggaggcggaggcagagcttgcagtgagccaagatcgtgccactgcactccagcctgggcgacagagcaagactccatctcaaaaaacaaaacaaaacaaaaatatatatatatgtactgcaaagctacagtaaccaaaacagcgtgtattggtattaaaaaagacacaaaaacaaaggaaacagactaaggaattcagaaatgaatccacatatttacagctaactgattttcaagaaagctgtcaagaacatacattgaataaaggataccctcttcattaaatggtgccaggaaaactagatatccaaacacagaagaataaaactagacccttatctctcatcacttacaaaaataaactcaaaatcaattaaagacttaaatgtaacagccacaactataaaactactggaagtaaacacaggagaaaagcttgagaacaaagattgtatggctaacacttaaaaagtacaagcaacaaaaacagacaaatgggattatattaaactaaataccttctgcatatcaaagaaaacaatcaacagagtgaaaagacaacacccctcccttacaccatacacaaaaattaactcaagatggcttaaagacttaaatttaaaacccataactataaaaacgctggaagacaacctaggcaataccctccagtacatagtgatgggcaaagagttcatggtaaagatgccaaacgcaattgccacaaaagcaaaaattgacaaatgggatctaattaaatgaaagagcttctgcacagcaaaagaaactatcaaaaaacaaacagatatttctcaaaagaagatatacaaatcaccaagtttatgaaaaaatattcaacatcactaatcatcacggaaatgcaaatcaaaaccacaataagatatcatctcatacttgttagaatggctattattaaaaagacaaagcacaacaaatgctggcaagcatgtgaagaaaagaaaattattgtatattgttggtgggaatgtaaattagtacagtcattatgaaaaaaagcacagagatttctcaaaaaaactaagaacaaatctaccacgtgatccagcaatcccactcctgggtatacatccaaaaaaaggatatcagtgtatcaacgggatatctgtacctccatatttactgcagcactatttacaatagccaagataaggaatcaatctgagtgtcaatcaatggatgaatggataaagaaaatgggaatatacgcataacagaatagtattcagccttaaaaaagaatgaaatcctgccattttcagctaaatggatgaaattaaacgtcataatgttaggtgaactaggccattcacagaaagaaaactattgcatgttttcacttatgtgagcggtttatgttcctggaaatcaaagtgggggccacgtttcaggtcagtagggtcagggatagagaccacagttatggacttgtgtgccctggagctatataaaattgatatcatagagataaagagtagaatgatagttaatagaggctgggaagaggaggggtttgaaaagaggttgattaatgaatataaaaatatataatagaaggaataaggtctagtgttcattatcacagaaagtgactacaacaatttgttgtgtatttctttttttaatttcaatagtttttagggaacagatggtatttggttacatggataagttccttagtggtgatctctgaaattttggcatacccatcaccaaagcagcttacccaatgtatagtcttttctctctcactccctcccaccttcccattgagcccccaaagtccactgtttcattcttgtgcctttgcatcatcatagcttagctcccacttacgagtgagaacatgctatgtttggttttccattcctgagttacttcatttagaataatggtcaaatccatccaggttgctatgcatgccattattttattcctttttaaggctaagtagtattctatggtatacatatatataacacattttctttatccactaattgattgatggacatttgtgctggttctatagttttgcaactgtgaattctgctgctgtaaacatgtgtgcaaatgtatctttttcatataatgacttcttttcttctgggtagatacctagcagtgggattgctggatgaaatggtagatgtacttctagttgtttaaggaatctccatactgctttccatagtggtggtactagcttacattcccaccatcagtgtaaaagcgttgtctttcaccacatccatgccaacatcaacttttgttttttttgttttgttttgttttttggttttttgagatggagtctcactctgtagcccaggctggagtacagtggtgccatatcagctcactgcaacctctgcctcccgggttcaagcaattctcctgcctcagcctcctgagtagctgggattacagccaactgccacaatgctcggctaatttttgtattttcagtagagactgggtttcaccatgttggtcaggctggtctcaaactcctgatctcgtgatccgcccaccttggcctcccaaagtgctaggattacaggcgtgagccaccacgcctcgccctctttttgtttcttttacacgtggtattgcattgtggttttgatttgcatttccctggtaattagtgatgttgagcattttttcatgtttgttggccatttgtatatcttcttttgagaattgtctattcatgtccttggcacactttttgatgagattctttttttcttgctgattagagttccctgtagattctgcacattagccctttgtcagatgcagtttgtgaaaattttctcccactctgtgggtgatctgtttactctgctgattattttctatgctgtgcaggaggcttttagtttaattaaagtcccatctatttatctgtgtttttgttgcatttgcttttgggttcttggtcataaactctttgcctaagccaatgtgtagaagcattttccaatgttatcttctagaatttttatggtttcagaccttagatttaagtctttgatccatcttgtgttgatttttgtataaggtgagagataaggatccagttttattcttttacatgtggcttgccaactatcccagcactatttgttgtatagggtgtacttttcttactttggttttgtttactttgtcgaagatcagttggctgttaagtatttggctttatttctaggttctctactctgtcccattggtcatgtgcctatttttataccagcaccatgcagttttggtgactatagctttgtaatatagtttgaagttgggtaatgtgatgcctctagattggttctttttgcttagttttgctttggctttgcagactcttttttagttccaaatgaattttggcattttttttctagttctataaagaatgatgatgatacattgataggaattgcattgaatttgtagactgcttttggcagtatggtcattttcacaatattgagtctacccatccatgaacatggaatgtgtttccatttgtttttgtcatctgtgatttctttcaacagtgttttgtagttttccttgtaggggtctttcacctccttggttaggtatattcctaagtattttatttttacagctattataaaagggtttgatttgattctcagcctggtagatgttggtgtatagcactgctactgatttgtgtacatagattttatatcctgataaatagaattattatgtacttctaaataacaataagatttgaaatattcccaacacaaagaaatgatcaatgtttgaggtggttaatatcccaaagaccctgatttgatcattacacattgcacgcatgtaccagaatctcacatggaccccataaatgtgtacaattattctctatcgaaaacatttttttttaaagaaacatgcaggaatacactgtacctcttccttgctgtctctggatattgtcacatgaggacttgacatgcggattgtggcagcctctgtgaccaagagcagaagacaatagcagcatagaaacctcaaatgaaaaacctaaaatctcaagctactaatttagccaaccttggcatcagctatctctgatcttagtacatgagatgataagcccccactgttcaagttgggtggccatcaattgctgcagaatagaatttaatgaggcttcctcctcctggatcctctactagaccctgacatgcccattcagtcacaggcagaaagggaagctcagggtaaggagacctggctgactgtgccagaagcagatcttacctgtcctgcttagaacactcaaaactcaattggttaaacaaaaaaaggaaaaagacagtaaggagtatagcactccccagatgcaacttaatgaaacactctatactttagattttctagacatacatagaaatcagaccactacttctgcagaacattttactggtaaaaagaatagcccacatgagggaaaactgatttggtggaaagacaacaaaaacaaaacatgggaaataggtaaggtgataacatggtgggaggttttgcttgtgtttcaccaggagaaaatcagcttcctgtttggatacccactagacatttgaagttccacagtgaacccatcagagatgcaaatgaaagtgcctctgcagagacagaaaacccgcaatcgagcatcatcgactcgcagggtgaacaaaatgtgatatcagaagaacaaatgaagttacaatccaccaaggaaatggcacatgtggagagccagggagaggaagagaaagaaaaagagacagagatcagagaaagacacagaaagagattggggagagaaatagtgtaaaagagagagagagagaccgtaagagaagggagacaaagagataaaaggtgcgagtgagcaggtgaggagaaagactgaaaactatgagaaacagcaactaagacacaaaggaggtgggagactgcgttggtgccgcagcagccacaccgtcctcttgcccccgtcacttgggttaaaaccaccggaaattccactattgcaaattttttattaatccttgtatgtctgtcctttctatttttagtctacaggtgtatccagcagctccagagagacagcgaccagcgagaaggggccatgatgatggtggtggttttgtcaaaatgaaaagggggatatgtagggaaaagaaagagagatcagactgttactgtgtctacatagaaagggaagccataagagactccattttgaaaaagacctgtactttaaacaattgcttgctgagatgttgtttatctgtagctttgccccagccactttgccgcaaccactttgacccaatctggagctcacaaaaacatgtttgtatgaaatcaaggtttaaggcatgtagggctgtgcaggacgtgccttgttaaccaaatatttggaagcagtatacttggtaaaagtcatcaccattctctcgtctcaataaaccaggggcacaatgcactgtggaaagccgcagggacctctgcccttgaaagctgggtattgtccatggtttcttcccatgtgatagtctgaaatatggcctcatgggatgagaaagacctgacggtcccccagctcgacacccataaagtgtctgtgctgaggtggattagtcaaagaggaaagcctcttgcagttgagatagaggaaggccgctgtctcatgcttgccccctgggaactgaatgtctcggtataaaacacgattgtacatttgttcaattctgagatgggagaaaaaccaccctatggtgggaggcgagacatgtttacagcaatgctgccttgttattctttactccactgagatgtctgggtgcagagaaacataaatctggcttacatgcacgtccagtcatagtaccttcccttgaacttcattatgtcatagattctattgctcacatgtttgttgctgaccttctccttattatcaccttgccctcctactacattcatttttgctgaaataatgaagataataatcaataaaaactgagggaactcagagaacggtgccagtgcaggtccttggtatgctaagcgccggtcccctgggcccactgttgtttctctatactttgtctctgtgtctgatttcttttctgtctctcatcccacccgacaagaaatacccacaggtgtggaggggcaggccaccccttcagtatgagattacaggcatgaataaccccacctggccacctaactcactcttgagaggccagaagtgatgctggaactttcttcctctgtgggtgaaaaagggaaaattagggagaacacaaggcatgagagatgcagcgatggatatgtctatatggagcttctgtctgcatccagtagaaaatgcatttctaggcaccaggtttaagagcgaaaacctggagtcttgtctgttagcattctccttccccacaaaccagagagggaatacatttgctccagcacacccggatgtaggaaatgtcacattcctatttctgtaacttcacttaaatctgctctgagtccctggatgcctggcaggtggagaattcaatcttgtcgttaccagcattcctttcccttctccatgggcttatgtaagaattctgggcttacacactgttggaaagccaggtaggaactacatcccctgaactctccattcttccacctgctcatgatccatcaacattctttgggccacctgctatagcaagaccctactcacagcatcattccactgacccacaggctcagccccagggaccctcactagaacaggtctccactatgcataggaactcacaaaaaccttctcttcatcttggcttcctctgatatccagccactccccaacttctcaccttaaacacagatggcagctccttcccatccttccaaacctgggggattgtccagccaaattctcttcagacaccaaagcttcacccgccctctttagggaggtgctgcaagggcatctgagatctttggaagcccaattctggcctctctttggggtgggctgagagtgggaagtagactctcttttccaaatgccatgtgtatcttgttcatcattatattatctccaatgcctgacacatagtaggcactacagactggcacatagtaggtgctattagtgtctgtataatgggactcttgaggttgaagctattagcaggaacctgccaggcaaaaggatggaaaaccaaccaccaaaaaaaaaaaaaaaaaaaaaaaaaaaagaaaacaatcgtggctttgagctctaaacacacaaggcaccaacccaagtttgggcaattttaatacaacagccattttgcctccaaacaaactgacactgggaacctccctctgcctctaaaagagaaccagtttccctttctctaagtgggcagcatttctcccctgtggcagtacccagcccactaccaccagcaaaggactgcagccaggacccaagagcttgagagtttaaagaatagattttatacggaaaaataaagtaacatccacataaatctggaactaccaccactttccagaggccgaatcccatttgtggagtctcttgcgtgtcaagcaccttgcagtcagctcaactacacacttttgggattcgttgcagacacgagagaaggttatcagcaaaataaaggaaccagggctcagaattaccagaacaatccatgacagaggaggtgagtagaaaagggaagggtgaagtcaaaggagagaagtcaatgagttggccaacaccaaacaaggatcatgggaccctctccacgaccccacatctcaaatgaagtcaacaaaacccatcaatgcttggtgtaagtgttgtatgctcccggaaatgaaagcaggggccacatttcaggtcagtagggtcggtggtagaggcagcggtcatggacttgtgggccctggaggatgggatgattctgagacattgaatccctgcactgatctcagttgaaatctcaggtagggcttcaacattcgtggaccaaggactctgtgggcctgagagcaacagccttggtgcatgtcccagctccatcaatcccaactggggctttgaacaagttacttatttttttaactaaagttattttaattgacaaatcaaaattgtacacatgtatgtgatgttttgatatgtgtatacaatgtgggatgattagatcaaactaatgaacacgtccatcccctaatttactgacaattttcatgatgcaacatttgaaatgtacccacttagttattttgaaagatacattattatttactatagtcacgctactgtgctatagatttcaaagcatataatccagcaacccaacttctggatatagaccaaaaaaaaatcaaaatcaatatgtcgaagggatccctacattcctatgttcactgcagcactattcacaatacccaagatatagaatcaacctaagtgtccattagtggatgaaaagataaagcaaatggactatatacacacaacggaatactattaacccttaaaaaagaaagaattcctgtcattttcaacaacatagatgaatttgaaagacattgtgttaagtgaaataagccaggcacagaaagacaaatactgcatgattttacttatatgtggaatctaaagaagtagaactcacagaaatagagagtaggacagtggttatctggggatggggtgaaggaaagggaggggattggagacactggtcaaagggtacaaagtttccaataggaagaataagttttgaacaagctaaactcctctgaaagttcagttcctcatctgtagagcagggacacatcatcaaccttctacggatgttgctgtaagagtaagagatgatgttcaacacaatacctaacacacagtcaggtctccttaagcttgaacctgcatccccatgacctctacatctcaggacagaagggctcacagccagtgtctcagttcccaatgaaaagtggatcccagaccaggctgaacagcaggatccctaggggataccccaccctactgagtcaaaatcactagaagtagagcctggatatgtatgtatgtgtgtgtatatatatgtgtgtgtgtgtgtgtgtgtgtgtgtgtgtgtttgtgtgtgtatgtataagagacagggtcttgctctcaagtccaggctggagtgcagtgtcacaatcatagttcactgcagcctcaaattactcctggcctcaagccatcctcccatctcagccttcagagtagctgagactacaggcacatgccaccaagcccggatacttattttttttttcttctttttgtagagtctcactctgttgcacaggctggagtgcaatggtgcaatcttggctcactgcaacctctgtctcccgggttcaagtaattctcgtgcctcagcctcctgagtagctaggattacaggcatgcaccaccacaccaggctaattttgctctttcattgttgtttcttgtttgtttttcacaaataggacttcttatttgctactgttttaagtctgaactttaaacagattcttggactgatggttcatatccatcagctcattcaactttagcacgcatctcgtccctagtgggttttccagaatcaccaccatcaccaggaagctctattcctttcaaatccagggttctccggcatttttacttttctaatgaagacatcatggagaggatagatgggcaagccttttctacatcttttccaatgttgtctggaatcaatttattaaccacttctttcaagtcatttgtctgcacctctcaggtcatgatttccatcatcttcttctggatttggcagactgttggtgctgagcataagaggtcttcagtatctgattgttgtgttttttagtaaaaccaacacaaaacagaagaaagaagtaaccatcggtagtcttgacatcaacatgagcttcaattattgttgaacatttttcaaccttggaatatattttgtcacaggtaatacccatgccattgaagttagtcaggcagcttttgccctgaacatcttcagtaatcagcttgaattttctaaatgcaacttcatcattctgcaaatcagcaagactcatttcaaacactagaaacttgagaccatcagatgcaatttgggttcctttggtcctggtgaccaagtctttccaatatttcttatattgaacatagcaggtgctttcacatcatactgatctttcttagagaatggaccaactactttcttcttaactccctttttgccacctttcataaggcacttgttcttaacaaccgccatggtgctgcttagagtaccaaaaggctaaattttatatttttggtagagacgggatttcaccatgttggccaagctcgtcttgaactgatgtcaggtgatctgcctgcctcagcctcccaaagtgctgggattacaggtgtgagccactgtacccagctgatatttattttttctttttttgtacagacagggtcttgccatgttgccaaggctggcctggaactcttggcctcaagcaatcctcccactgcagcctcccaaagcactgggatttcaggtgtgagccaccatgcccagcctggaatctatttttaaagcaatcaagtgttgaataaaattgcaacttgggctgttttttctttgcattttttacatttcaatggtttttaatatattcagagatatacgcaaacattaccagtcaattttagaacatttcatgacctcaaaaagaaacctcataccatttagctaacacccccatcctcccatgcccctaccagccctaagcaaccactaatcgacttcctatttctatagatttccatctgaatgaaatcatgtagaatgtgatctttcatctgttttgaaggtttatccacgctgtagcatatgtacattcctcctttttgtgatcaaataatattccaccatgtgtgtagacaacaatcggtgtctctcttcatctggtgatgggcatttggattaattccctctttgtgttattaagagtgatgctactgtaattattcatgtacaaatttttgtgtggacctgtgctttcatttttgaatatgaaaatatggcacatctccaaggaagacatacaagtggccaataagcacatgaaaagatgctcaatgaaattcttcatcagggaaacagaaatcaaaaccgcaatgagataccacttcacacccataaggatggctagaatcgaagatagagaaaattggcctggtgcggtggctaatgactgtaataccagcactttgggagaccgaggcaggtggatcacctgaggccaggagtttgagaccatcctggccaacatggtgaaaccctgtctctactaaaaaaatacaaaaattagccaggcatggtggcaggtgactataataccagctactcgggaggctgaggcaggagagtaacttgaatctgggaggcagaggttgcagtgagctgagattgtgccactgcactccagcctgggctacagagcaagactttgtctcaaaaaaaaaaaaaaatacagaaaataacaagtgttggtgaggatgcagagaaactagaattttcatacactgctggtaggaattaaaatagtgtagccactgtgagaaacagtttaacagcttcccaaacaattctacatggagttaccaaatgacccagcaattgtacttctaggtataggcccaacttgggctcttttaatctatggaaaatgaactatcggtacttggcaagaacaaagagggagagaggcagaaatggagccacgagggcacattgattggtctgtagtacacagggctcctactgcaaatggtctctaaatgacttcatcagttgctcataaaaaaaaatcaccctctgctccaatcatggaggaaaaagtatggattggacctggtgagccacggtaagactgactgctaaacttcatgaatgatgaggggatttgcacgtataatcttgactgtactagattttttattttatccactgtctttgaaaacctaactcttgactaagaactaactttcctgtacttgttgttgagtctaagtaaacttccaattccacatagtccaaagatgatgtgttgagaaatctctcaaaagaaaaatgctaagaatacaggcagagttatgcggcaagttttgcagaattaacacaaattgtattgtaggtatgaagcacagaacattttcatgggtaaagaaaaaagtgttcttcattctagtagacactgcaggatgaggccgatcaaggtccttgcccagccagaccttgggctcttacctaatttgtgttagagtcaaccctgatggagtctgtatctcagtcatctttttttttgacatggaatctcactgtctcccaggctggaatgcagcggtgtgatctcagctcactgcaacatctgcctcctgggttcaagcgattctcctgcctcagcttcccaagtagatgggactacatatgcatgccaccatgcctggctaatttttgtacttttagtagagacgtttcatcatgttggccaggctgtgctcaaactcctgccctcaagtgatccgcctgccttggcctcccaaagtgctgggattacaggcatgagccaccatgtccgatctcagtcatctttttatcctccatacctggcaagttctagacacactgtggttccatacaagtttgttgaataaataggagacagatagaaagtgggaactctgcaagtagagaagattccagaaattgtgcatatttcccagagactgtggccaaattcctcagtcctgccagagtttctctatctcaactcaaaccttatgtgtgggcccaggcgcagtggctcacacctgtaatcccaacaatttaggaggctgaggtgcgcagatcacttgaggccaggagtttgaaaccagcctggccaacatggtgaaaccccctctctactaaaaatacaaaaattacccaggcatggtggtgtgcacctgtagtccctgctactcggggggctgaggcacaagcattgcttgaacccaggaggcagaggttgcagtgagtcacgattatgccactgtattctagcctaggcaataaagcaagactgtcccaaaagaaaaaaaaaaaaacccttaagtgtgggccttgttacagaattaacgtttatatggacaatatgtacatgggtgtatgttaagagcatgagtcatccacaagattttagcaaagtccatttagaaagctcaatgctttgggcttccacttgctttgctgcctctgtcctcagaaggaggcttcatccttccatataatcagcaaatcctttatgcagagatgtacacaacacactcctatccttggctatgacaccttgaaagggtcctcttggtgtcccctggtgctcatttcagagtagttcaaattaaggtgatcagctttcatgccaatcactctacaaatcactcttattatgaccaatttttctaaatggtttattgaattattacttaaagaaatgtgcacatagaagaggtcaacacagtacttttcttacaaactgaacatactggccagacgcagtggctcatgcctgtcatcccagcactttgggaggccgaggtgagcagattgcttgagcccaggagctcaagaccagcctgggcaacatagtgatacacccctctctacaaaaaataaataaatacaaaaattcagcaacagtgatgggacatgcctgtagttccagctattcaggagggctgaggtgggaggactgcttgagcccaggaggcagaggctgcagtgggccatgacggtgccactgtgctccagcctcggtgacagagcaagatcctgcctcaaaaaaacaacaacaacaacaacaaaaaactgaacatctccatattactgacaccgaattcaagaaacaaaatattacagccccttccaggatattcctggggtcttttccatctctactaacccctgactacaaacagcctccacctatttcacctgacattgtactttatgaaagcagcagttctcagatggggctattttgtcccctggggacattaggcaatatctagagacactggggtttgtctctacttggggggagttgtgttactgcatccagtgagtccagggatccagggatgccgctcaacatcctgaaatgcacagggaacccccacacataaaacagagaaactgctgagccaaaatgccagcagtgtcacagctaacaccctgacatacacactatcacacagtatctgctcttttgtgctcaggatctctttcattctaatcatctcataggaaacagaaatgttattaggaggtaggtagagtccaaaacaaagaagatccagagttttttgtttttttttttttttaatcagcctggtgcctttagagctaggatttagtttccattctttctatctcattttcaagtgatttttcttcaaatggcatctgctgggctcaagatccggaaatccccacaaagctgagattcacatgggaattttgtacacacccacacaggtatacactgccatttgcatgcagacatccacccacagatacacacatccggacaccaagacagaaagcaaactccaacataaaagcacggtttcccgaactggagaaacccaccattcactccagggaggtacctatttgtttaattcagcctctgatagtcaggctgttgccaagcgcagttctgaaactcttcccttctaggaaagagagatggatttttttctttactcaagaatatagatctaaaaaaagcaaacacttctgcatctcaaagcaggctctacctcctgagctacacatattgatcagcattttattgtcaactttcttttatttgaattggagaaaaatataacttaattatgttcttactgacagtttggaatcaggtacactaaatccaattctctgggttctcgtgattaatgtgtttaatttgggggacaacaaagcaaaagcattggtcgtgttttaatataaatagtacaggatatatctaaggggttgaagtatcactgtagcaagaagctcattctgcagtaaaaggcaggttctgccactaggattgagttagggtggttcatggctgcaccgttttatcaatgtctcttcaagagtccatggaatgtggaatgggaaagactgaaatagtccaagtcttggctaagcttctattaaggggtgttaggagctgataaaataacctggtctttaaagacatcccacacagtagttctctaagctacagattctcagatttttctattttataaacgggtaaaatttgttttttttaatttgagaaccaacataaggttgctattttctttttctttttggtaagaaggaaattttttaaactaccagttacacacacaaacacacacacacacacacacacacacacacacacacacacacacacacggaatttccaccatgattggtcagaataggtgaggttttgctgcaataacaaacaactcctaaatcttggtaacttcaaacatcagaagttgtgtttcttactcatgctatatctgcagggaggtgtggggtgctctgtttcccatcaaactttccctaagagtaaggctaatgggggttgcaatacctcgagtatcaccaagcagggaacagagggagaagaatgctagagagccttgtactaagaattaaatgcttcgggctagaagtctaacactgcacttctgcccccagcctcttggccagtactagccacatcccttcccccaccacactgcaatgcatggagacaggagaattggatacattacaaatttctaccccatggcatttcataaaagagaaaaaaatgcaaatacaaaaatgttttaatagaatagaatatatacatttttagaataaagaaaaatcctccaaaaaggacagctggtggtctttcaccaatgggcacatttctgtgacattttctctgtttttccattttatccttgacctatgaatattttatacagatggtccaaagaacacaatttgggaaccactgctcttatcaggtgatgaaaacggccccaagaacagagcagagtctctttagcaaagacccagcagggccagggtgaccacgttctcaccatcaatgtgcagacatccacctgcagcatacttacataccaacatcaaacagtggctctttatagcttgattctaatgccctttgatcttcatactcattgtaaagctctctggccccaagatctaacatcgccactctagctacgtcctgcaactgttcacctctcctgactcctcatccctctaaacttctcttcacaacctcatgtttccttcttgctatacattcctgctcagcctggacttaacagataccttcctcttgtaatgtgctcctaaacgcgttcttccctgccttcaaccacacccacctggaaaatctccataccccattgatgacttgcctcgcaactgaccaagggctgctgaatgatactggaaagaatcacaacagggatctcgtagttccactaaataatctcaccgtccaactctaggaaagacttcacttctgttcagcaatatttttaagcatcgcaaataaattccaaaccatatttgccataacaattgactttaagcctcttccatatctcaaaaacccccaaacccatccctaggggtgaaaagagcccagagctgagttctctcaactcacttccatctcacccctagatcactgtatcttgaccctcttcctctgcctttcccatcttataaggagaaacatccttctcctttcccaagctaccttccccacttgtgcctcatttgagacctccctttatcacccgttcccttggaactcccatgactcaccaccttcacttgtcatttcactcataaatattttgcaccatgtatgtgccaggcatttaacatatagtcatgcttaagtctccacatgctaataagaaaaaccttgattatccctgctatgccctcaagtcattaccctccccgctcctttcctgtgttcccaaactttgttgatcttcatcaatccctctgatgcagatggctccgaagtttgcatcctattaggtttgtgcaaaagtaattgcggattttgccattaaaagtaatggcaaaaatagcaattatttttgtaccagcctagtatcttttctccttctaccaaactttgtccctgagccatctcatcacctataactacctcctccatgcagttgattcccagatctgtattattctactgaaagtccattccccagctttctcagctagaataacagaagcccaattagaattcatgataacagtttcccaccaccaccaccaccaccaccttcgccctgccattgttagcaaaaccatctcttgagtggagctcaaagatttgtaatctcccactccccagaaagataacttcagactcagcctagaagtaaagatcctccagatatggcctcaactaccctccaacccatgtccccagtgcatccctttgatgcccccttcagtggagttaaaatggagtgagtgtttttcttttcacatactcctggtgttcttccacaaatacaattttcacctcttgaatattttcaaagattcttcatgctacacacagtgaaatccaaactccccatcaagacccccgtcttcccaaaccctctttgcagttttctgcctccacgcttttccttgggtcatcctcttctctaatgtaaccttgtgtattactctaagttctccagagaaagagcagagagatagaggtagatctatacacatagagacagattgatttgttgtaaaggatggctcacatggttatggaggctaaggagtcctggagtctgcagccagcaagctggggacccaagacagccaatgatattgttccaactcgagtccacatctaaagtcaggagaagattgatgtcccagctcaaatataatcaggtaaaaagagcaaattctctctgactctacctttttgttttgttcaggccttcagtggaatggatgaggctcacccatattggggaggacaatctgctttattcagtctaccaattaaatgttatcctcatccagaatacctcagagacacacccagaataatgtgtaaccaaatatctgggcaccccacaacccagtcaaattgatacataccgttaaccatcatgtcttgcttctactctctccccattactggatggccaaatccttcccttatttcaaggcttagttcaaatgttacctcttaactaagccttccctgctaaccccaaatattaatagaattggtttcccccttctctgatatctcaaaatatgttgtgtgtttctcttttactgtatttattacaaactcccttataaatgaagacagtgattcccagacaaattatcacaagagtataaaagaagtcttctttgagtgtgaaatatctcatggaatatagcacatggcctcttcatgaagaaactactgggagagaaaaagacaagctggaagaggccagggagagggggtcagtacaaagcacaatgaggctgggctcatacagttgctcacacctgtaatcctagcactctgggaggccaaggccagtggatcacgaggtcaggagatcgagaccatcgtggctaacatagtgaaatcccgtctctactaaaaatacaaaaaagttagccaggcgtggaggtaggcccctgtagtcccagctactcgggaggctgaggcaggagaatggtgtgaacccggcaggcagagcttgcagtgagccaagatcgcaccactgcactcaagcctgggtgacagagcaagactccatgtcaaaaaaaaaaaaaaaaaaaagcacagtgaaatgtcagtggatgggtgcctataatttctaagggaaatagagtataatccaagaattttatagccagctaaattattgcccaatcaaaataggcaatagacactatcacaagttcaagaacttaaagaatacagtatttctgagctctttaaaaaaaaaaagtcttcataataaaatttagtcagccaagaaattaaaaaataagcaacttgtgaattgaatgaccatgacaaaaggctagtgatgagaggtgaatccatttaaaaataggactatgagtgcagaacagaaagaaaaggtggcccaccttaacaacacaaaacaacctagaaatcactagtttccagaggtaaagggagggactgtaggaagtagaagtgctaatgccctttatttagtcaattaatcaggtgtaaaattgaaacgtggttttaaatatataacttcttgtttattttcctccctaactacctgaggatcaaccaccatgatgaatgacacagcaactatctggaccaggaagttcatgaccaatcgaccgctccagaggaaacaaatggtcaccaatgtccttcaccccagaaaggcaacaaaatgtacaagaccacaatggatgtcatcttcatgttaacagttggacacagaacccatgttggtggtggttaaacaatcgtcatccacattggagtgcagtggtacgatctcagctcaccaaatctctgcctcccaggcttaagcaattctccttcctcagcctcccacgtagctgggattacaggcaagcaccactactgcctggctaatttttatatttttagtagagatggggtttcaccttgttggccaggctggtcttgaactcctgacctcaaatgatccacccgccttggcctcccaaagtgctaagattacaggcatgagccaccgcgcccagccttttctgtattaaatttttaaaaacacaacatttaaaataatcaagtcattctttttcaatctactttgtattataggtattcaaatactcacctattctccctcacatgatgacaaactcgttgaaatgtcatatcattttgtggctccagccccagggattctgactctgattctaaagggcctgcatgcagaccgagcaagccccctggatgcttctcttacaggtgttttaagggcagcagtttgagacaccctgatgcaaaagaacgaaccctcaaggaagttggctgtacatgtattttccttcctagcacaggaaacgacagaaagattatccaatcagtaccactcatagcacctgattatatgtgtatgaggaattcagaaatggtttgatcaaggttcaagacctaaaaagaagcttttctctcggccaccaaatccccatctcatgcgtggttgagttagcagaaactgaggatgatgcttcttcctccagcattggtatcctatggtttttgttgttcagtaaatgaagtaactccatcccccaacatcctcaagctcaattccagttttctcacgtacacttttttttttttttttttttttttttgagacagagtctcgctctgtcacccaggctggaatgctgtgcagtggtgcaacctcagctcactgcaacctccacctcccaggttcaagtgactctcctgcctcggcctcctgaatagctggcattacaggcatgcaccatcatgcctggctaatttttgtattttttagtagagatgaggtttcatcatgcagtccaggcttttctcaaactctcagcctcaagtgatccacctacctcagcctccctagtgctaagattacaggtgtgagccaccgtgcccagccccctcatgtacacttttacagaagatctgatcatacccactctgaagaagtcagaatggcccccacgtggtgttaaacgggagtgaaaacttgagttcaatcaactgagggtgacacagaaacatttcccccaaaacgcttttggcagctctgctgatccataacctggctccatttcagggcaagacctccacttaagctgcactggcttccactagagtaaatcacattaactcatggcaaacacaactgaagggcaaaaagtttctttttaaaatgatttttgtctctcacttaccaacacacgctggcctccctagagccggactccattcagcacctgttccactgagcacccactgaaagctcagctcatgagctgagatgacccagacatcaaggagtttacaatccaggggaagaacagacctgaatacaagtgatgacaatacaagacagagtcaaagagcccaacttgaagtatcagcagaatagcaccaaagactagttcccaacccagctcccagcgccagagccagagccaggctgtctgcatgggatcagctgggagattttgcaaacctaggtcctagctgagaccctaatcatcaggctggcagtcactgggagtgagcttcaggaactggtttatttaataagcacccacacacacatgattctgatgttcctaagggttgtagaaacatggaagtatagaaaacactaaaaaaaaaaggcactaaaagaaacctataaatattcactaccattccaggcatcatgaggacactccacgtgcactctttacaatacttagaataacctgcaagggaagcattcattcatgacgatgggctttagtgagatcagagccagccctgggaatgtttgaacctgcgctgaaagtcaccccctcctccccacaggaggaggctaacattaaggagcaggggccagataggaaatggagtgtccttttattatgagaccacagtgacagactttattttttttttccagagtctcgttctttccacccaggctggcctccagtggtgcaatctcagctcactgcaacttccgcctcccgggttcaagtgattctcctgcctcagcctcccgagtagctgggactataggcacccgccaccacacctggctaatttttgtatttttattagagacagggtttcaccatgttggtcatgatggtcttgatctcttgaccttatgatccgcctaccttggcctcccaaagtgctgggattacagatgtgaaccaccacgtctagcgtcagactttcaagtaaagccacaatggaccacagaacttagacatcagggctaacatggaatctctgtcattaaatcttgagatcttattttctttggtcaaagaaaaaaataatcacaattgacattttgaggacaagacatctgaatgtaaacttgatcttagaggatattaaggaattactgctaatttgattaggtatgacaatgatcatataaaaaatgccctcatgtttttagagggaaagtaaattatgtagcggtgaatatcaggatgcaattaaataactactgtaaactattttgtaaatacttcagaaaaacaaatggagtaaatattgcaaatgttaatagtttttaaatctatgtgatgggtatatgatagctcattaaactggtgtctctacttttatgtttattgaaaagttttcgtaataacaataaaaaaaaaaaaaaaacctcggccaggcacagcagctcatgcctgtaatctcagcactttgggaggctgaggtggatggaggactgcttgagcccagcagtttgagaccagcctagacaacatggtgaaacctcatctctacaaaaaatagacaaattagtcaggcatggtggtgtacacctgcagtcccagctactcaggaggttgaggtgggaggatcacccgagcccagaaggtcaaggctgcagtgagccaaggtcatgccactgcacttcagcctgggcgacagaccctgtctcaaacaaacaagcaagcaaacaaaaaccgtcttgatcccatttcccaaaaaaatgattttttttgagatcttaccatctcctggcttggtgcagagtacaggaaatcaagacaaagtacagcacacaaggaataaggagggagggaagcgtgggggaggctgacaccgtggactctcccagctcagtcgacccatgcgtcttgcttcatggaagaaaggaatggaagatgaatcatgccttcagcacacagtgaacttcctcactagtaaatgtgcctccagaagtgtccaagaactcagtgccagagccaggctggctgcatgagaatcacctgcgagtttttgcaaacatagacccctactggctccaaatgtattcatctcttggagaggaggagagaggcagaacaaggaaaaggatgggaagaaaccagccttgtgcacaggaggatgctgggattcctcctgcaagtttagcgcaatgcaccctattttacaaggtcacagaagctcagagatgtaaaactgcccaggttctcatagcttgtaagtggtaaaacccgcccaagtctctgtctctagagatatttccacttgcttcaactctggagctgtcttagttgtaaagatgacagattccactcctcactcacttttgttagcagatattgcctaaggtcccttgtgaatatttaggtcagggctttttttttgagttttttgtttgtttgtttgtttttataaaagcaatcttgtagaaagaacccaaagtggctccccgttttaagaccctgcaaacagagagaccagagtatggagtcttggtctgatttccacaccttccttagatttccctgtgtgtaaaatccaacaacaatctttgacaaattgcctcccccaggggagagatggaggaagtgttaactttgcttttttttttcttttttcagacagagcctcactctgtttcccaggctggagtgcagtggtgcaattttggctcactgcaacctctgcctcctgagctcaaatgattcttgtgcctcagcctcccgagtagctgggactacaggcagatgccaccacacctggctaatttttgtatttttagtagagatgtggttttgcatattggccaggctggtatcgaactcctggcctcaaatgatccaccctcctcagcctctcaaagtgctagaactactataggcatgagccaccatgcccagccactttgctatttttttaatagacagcttcgaggtccagtatgatttcacagattaggaaacatcacaggcaaagaagaacactttgcactcaaatagtagaatgttttcattttcaaagagctctcacctgccatctaatcttgtcttcctagcagtcctgggagagaagtagatgtggtttccaatcccactttccaaaagaggagactgaggcagaggctttgcagatacacagaggacatgtgaggacaggtgaaggtcatgatcattgtcagcgccctcccccaacttgacattcccagacctagtggacttccaaacacaggagacagaagaactgatcaatcaattctgccatgggtgccaggacccaatttttccctggctaactcggtcacatcctgtctgggatctccaactattatccatcccacaagtctcagctaaaacaggaattcaacggggaacatttttctgaggctccaggattgggctaggccctctccatggctctctgaccttcccctactgcagaacgtagcacctgtatgtcactatttgttcaaacatgtgtctttcatatgctctccacgttgtctgcagcatctgccaagaataataatgaatggtaaaacctaatttctattgagtgccgatgatgcacttttaatgtgacatcttatttaatcctcactatatctgcaaaagtagaaggtattaatagccaattttcagataagaaagtcaaagcacagtttctataacttacccaagcagctaactaggaggcagctcagtatgagcccagggaatcatattccagagaccatgttctccattactagagcaggtacctccccagaatctagcaggtggttaacgagtctttgtggcataaatgaacagaaggacaacagatggatggatacataggtggatggatggataatgggtgggtgggcaggtggacgaatgaatggatggttgagtcagtgaagggatggctgagtgggtggagaaatggatgagtgggtgaggggttgaagggataaatggatggatgggtgggtggatagatggttagatgagtgaatgggtggatagatgcatgggtgagcggatggacagatgggttggtgggtgggtaggtggatgatagctgggtgcataagacagtgggttggttggatagatgggtgggtgggtggatagatgggtgggtggttggatgtatgcatgtctggatggatggatggatggatggacggatggaaggaaggaagggtggatggatggatggacagatgaacagatggacttgggcatttattcggggtcctccaaagaattgagtgatttccctagggtgtctcatcacctgcaggtaggtgggcaagggggcttgcctctgtaatactcatgattataggtagtgctcagccttagtcaccactctcagaacgctttattgactaggaaagtcaaaactggcattgataactaatgcaaattgcagctataactaacagaagatgttgagctgatgacagctgggcaaccaagaatcaataacttcgctgtgtcatattactgtcatgctgggcaggtagagccacggattccttcatccctccatcacattgaggatgcttatcaagacttccccaacaatggggacagggatattatcaaatacttgcagttcaccccaaaatgctcaccctcttcgttccacctgcacatgaccttcagctcaaagacatttccagtcctccaggtcagcccttcttccagcctttgaattaaccctgatgacggcctgcccattaggtgtcttcagctttcatcacacagccttttccaaggctctccttcagtccagccctcactaaacgctggaactgttgttgacaaaatccagaacaagctgggtgggggatgcagttgggaagcagactgtagtaatggggaaaaattctaagcaatctcgatcacagaaaagaaactgaacaggtaagagagaggcagtcaagagaacaagtgtgaattttgcataactgaagctgaagaagatcggggggcatggtagaccacaagataaatatgatatagcctcctttttaaaaaagtataaacatccaccctttcctactgacaactgtgcttcaaatattgctaaggtctttactaaaggtgagtcagaaaaactgggtattttatgcaatacagtaagaaggcccataggcaagtatgttcctgacaacaccttctaggataagccctgagattctagttacacctgtcctaaagttgtctctcactcctgctgttggagagctaccatgagagaagaaccatagtaaagtggttaagagtgtgcacccagcgaccggccagatggctacaaaccatcactatctaataccgagcaagttacataatgttcccaagcctcaactttctcatctgtaaaatgggtatgttgtcattcattaatcaaattctaggtgagcatatactaaacaccagagacacaaatgagaatcagaacaggcatgtccctggcccttatggtgaccacagtcttgaaggggaaggatgacacgcacagaaataggaagccatagctgagctagtgtctaccacagagaggcacctggtgtcatgaaagcagataacagggggttgctgtgactgagtcagtgtggccagacgtccctgaggatgtagtgactccagtgtcagatgagaccgtgaccaggtgaagaagcagggagagggaaaatttttccaggcggaaagagcaggatgtgcaaagactctgtggcaggaaaagaacaaaggaagtgcaagagcctgaaagaggccagagagagcaagtgaaaatgtggataatcacagcaccgacctcatacaggacttgcaagaaatcgagaccctgtctgtaacagattcagcaatgactaaatagaaactatctcctaaaagcacacgatgaggctccttggtggtatttcccacatgaggctgccatgcactcagaagccaagttcaacctgtctgtagacaacctccaagccagctggacacacataaaccctcaggctcaggatacccaggacagagtcctggatgcttgaagtcatgataagtatccagaatgacacagaattccagccaggcgtggtggctcatgcctgtaatcccagcactttgggggccgaggtggatcacctgaggtcaggagttcaagaccaacctggccaacatggtgaaactccctctctactaaaaatacaaaaaaaaaaaaaaaaaaaatagctgggtgtggttgtgggtgcctgcagtcccagctactcaggaggctgaggcaggagaatcgcttgaaccaaggaggcagagactgcagtgaactgagattgcaccattgcactccagcctgggcaacaaaagtgaatctccgtctcaaaaaagaaaaaaaaaaaaaatgacaccgaatttgctaaagggggagaaagggctttcttccaaagctgggcctggtttctacagagagtctttcacatgaaaattaggcagctctttgcaagcacctcagaggagaacccctcaccctgatgaatcaggcacaggggcagatccaagacaactggctgcgtgcatatgaacaagtctatggtggaaatgcagtgctttatttgtttgtggtggtttaatcaccaggagggagaagcttctaaagcagcattcagaggtggctgttgcctgggttttctggaagggggaggcggtgaggatgagggcttccctttcatctgcaggccccttgcagaaggagcttgggaaagctttgcaaccctctgcacactgtttgccatcttgtctggctgggacgccgagctccagatgggggcagatgggatagctcttgccaccgtatttggagagagatggcagggaagtcagcccccgtggagaagacaggagcaggcacgtgctggacagtgctgcccaggcccctggggctgaagtgtccaaccccacagcctctaggtgccactaaagcagcccaagaggaccttctctgtccatctccatcctggcacctacagacacttggagagagtccttcacatgggaactcacaaatgcacactgataacccccacacggaactctcatacgtagcaagtgaaaagacaggatgccagcttaacttgaatttcagataaacaacaaatcattttttagggtaagcaggtcccaaatattacatgggatatatttgcaccaaaaaaaaaaaaaaaaaaaaaagggttaatgagaagttcaggtttaattggacctcctgtattttacctggcaagcctaaccctgcataaacacaacctcgagcttgaaactcacagagaagccacggccgtgctcacacacgtgcacaaacccatatgccttacagagtcaagggctgtgatgagggtccccacccttgcacacttctctgtcctctgtctgggctcagagtaaacagggggtcacctggaatccacgtctaagctgggcttggaggtgtcctaatgaagcaggatgctgacatgcacttccccaggtcagctgggactgtagccaggcctagcttccagtctcgggcctagaacacacagcacagccccagaccttggcaagaaggcttcatctcaagggccactggtgcaggaactattagaagccccacttctttcctctgtttctgctgccattgccccagtctctgaccctgccactcaatcactctataaacacagcaggtactaggggtggctctgggctcagcactaaagacactgaccctggtaaagccacagtctagcaatgacagtcaaccacgtatcagcaacagccctgccccacacgtgctgactgcgcacaaggccggcgctgtgaacgtgctctcaacagtgatctcactgaaccctcatggcagctctaggatgcagacagtagcatcacattatccccattttacttttgaggaaactgaggcctgaagaaggcaaatgcaggcctcgagatttgcagtaacattgccaggaatgtttgagaaagcaaacttctccagagtgaggcagtctgccagagctcagaagccagagtccctgttagcaggggctgggggcactgtggggtgagggcagacaagtgggtaggggctggaacccccaggacaccagggtgcagactggtgtgagtaaaagaaagaggggctgtcatgccatcatctgcagaagatgatgtctacagaggacagtaccatgtgagcccttggggaggtggatgactggatggaattttgcacaggatgcaaattgagcacagatccccctctgacctagacagcccacttccaggaacatctcacagaaatgcaggcacagagcaccaagtgatgtgtgtaaggaaattcatcagaacaccgtctgtgactgggaaaaggcggaaaccatccaaagacgtatcggtgcagggctggttaaacgaagcgtggtgcatccacaggtcagaataactgctgggagaagaaggtggtacccaggttccaacgtgagacaatgtcaaagacatgctgcctgaaaagcaggctttccaaagaataaatatagcattatttcatttttacttttttaaaaatattacaataaacacttatgtgcaaatacatgtgcttgtgtgcacagaggaaaaagctgtggacagaaacagaaaaccaaacacggtgtgctctcactcataagtgggagttgaacaatgagaacacatggacacagggaggggaacatcacacaccggggcccatcgggggtgggggacaaggcgagggagagcgttaggacaaatacctaatgcatgtggggcttaaaacctagttgacgggttgatagatgcagcaaaccaccatggcacatgtatatctatgtaacaaacctgcacattctgcacatgtatctcagaacgtagaataaaaaataaaaagaaatcaaagaaaaaggtggggagaggtataacccaacccttcccagtgttacctctgagatgcaagatcaagaaaagcaaatcaagaggtagttttgctttctgttttctatataaattttttttttttttttttttttttctggagacatagtctcgctctattgcccagtctggagtccagggacacaatctcggctcactgcaacctcctcctcaccacaacctcctcctcactacaacctcctcctcagtgcaacctcctcctcactgcgacctcctcctcactgcgacctcctcctcactgcgacctcctcctcactgcgacctcctcctcactgcgacctcctcctcactgcaacctcctcctcactgcaacctgctcctcactacaacctcctcctcactgcaacctcctccttactgcgacctcctcctcactgcaacctcctccttactgcgacctcctcctcactgcgacctcctcctcactgcaacctgctcttcactacaacctcctcctcactgcaacctcctcctcattgcaacctgctcctcactgcaacctgctccttctgggttcaagggattctcttgcctcagcctcccaaataactaggattacaggcatgcaccaccaagcccgactaacttttgtattttttgtagatacagggtttcactattttggccacctggtctcaaactcctggcctgcccaccttagcctccaaaagtcctgggattacaggtgtgagccaccacgcctggcctgcattgcttgaattctcagaccacatggaccctctcatctggtccaattgcaagagtccaaggcaggaaaggcagaaggcaggggcttacccctccatcaggacaacatagaacagagtcaaaaaaggaaaacatgaatggatcagtcaagagggccgtgcacatgccctcccaggcacctacatcttgcaacttaagccgacagcctttcaagccacagagtcttcctccccagagactagcaaggacacaagccctggccaggcccttccaggaagatgttctgagggacaaggtggggggcacagtcaggggtggcaggaggaaagggggacacgaagccaaggaaaccagggcaccccatgcttcctgaaggcaactagaacagggcgccacacagagcccctgtgtacctgtttctacaacagcctgaatacaaggaaaaggaaaacaaggaaaatacacaaagcccagcctcaccaggagcaggttaaataaaggtgtgtgaattttcctcatgtcctttggaattggaaatccaagcttcctcttctgtgcctttaaggtcctggccgctgccgcacagctcccttctcttccctcctcctcctgtcctattttttttttttttttttttttttgagatggaatcttgctctgttgcccaggctggagtacagtggcacaatctcagctcactacaacctccaccttccgggttcaagcaattctcgtggctcagcttcccgagtagctgggattataggtgtcaccatgtctggctaattattgtatttttagtagagacaggttttcaccatattggccagtctggtctcaaactcctggcctcaggtgatccgcccacctcggcctcccaaagtgctgggattacagatgtgagccaccatgcccgaccctcttgtactaactctgccatctctttgcagtctcccctgagcagcttttcctgggcccgcactgcccccctccagagctgcactctcaaaccacgccccaatgccccctggccctggctcctgccccggggctctgatcctcagctggtgaggtctagagtgtcagagggagccagactccttagagaagctaaggcgggagacctgtgctgggctgtggttaaactgctcccttccagctggggccgaatagaaagtgaaagactgcccccagaatacagggccctcagaggccctggggatctgtgctggcagtcaggaggactgtcacctcagtgcagttgcctgcaaggagggctgtgcaggaagctgcatgttgctcagagaacaaaaaaaggaaattaaatgcaccatctccttattagcatgagcttttgaggcagacacttaaatatgcatgcctagacattgtaaaacttgggggaaatgttaatttcaataacgccacttcttgtgcttgcagaaaccattcttttatctcccttcctagtcatttgtgggctccatccctcagagtggcagcgccaagacagccggcctcactgggttttctaagctgtgcaaggtgagatcccaagccctggcctcgagacccatcttaggaaaatgttagaacagggcaacaagttgccatttcctccctcctttctcttccccatacaaaaatcagaaagcacccttgcccagtgcccagccacagtgaggaagaaaccccacacaaaatcctgggttgtgcccctgataccaaagacctgcaaaattgggcctcacctgctgcaacctcagcccagacttgtgtacatttcaagggtggctggactcatggccgcctgggacgtcagagtggtacgaagtcctcttaacctaagactgtcggggtacaaggatcagcatttttttcctttctctccagggccagatggtaaatagttcatctttgcaggccataggtctctgtcccaactattcaactctccactctccattgtagcaggaaagcagccacagacaataggcactgaaatgggtgtggctgtgttccaataaaactttatttgtgtgaacaggcagggggctggttctggcctgtgggctatagcctgcctcctctgctacagggtgatctccaaggacccatccatcttgtagaccagcagctggcacacaggagctgctcagatacttgaaggaggaatggagaaggcaaacagcccccagtgtgcagatgtgagggtctcccagcggcaccatcctttgccatctcatgccaagggacaaagccagagcagggctctccaccaaggctgggttctcctccaaggaaatgtgataacaggacagaaagcatcgtggaaggataggggctttggagtcccacaaaccacagtttgcaagaccaggagcatcctgcacttccttgcacacatcctgggtgggtactggagcatctagacttagagtgaatcttctccccatcctcccccaactggcctccattaaacttccagcaacaatgtggtgtatgtacacaatggaatactattcagtcttcaaaaagaaggaaatcctgccatttgagacaacatggatgagcctggaggatattatgttaagtgaaataagccaggcacagaacgacaaataccacatgatctcacttacatgtggaatctaaaaaagttgaactcggccaggcatggtggctcacgcctgtaatcccagcactttgggaggctgagaccagaggattgcttgagcccaggagttcgagaccagcctgcataacatagcaataccccatctctacaaaaaatacaaaaattagtggagcatggtagtgcatgcctgtactcccagatactcaggaggctgaggtggaaggattgattgaacttgggacctcaaggctgcagtgagccatgatcacaaccctgcactacagcctgggcaatagaaggagattttctccaaaaaaaaggaaaaaaaaaaaaagagaagaaaaaagttgaattcacagaagcagagtagaatgatggttgccagggtggggaagtgggcagatgccaaaggacacagaatgtcatttttagagaagaataagttcaggagatccatgggacaacaaggtacctatagttaataacaacatatcatatacttggaaatcactaagagagtagattgtttaagtgttctcaccccaaaaagtaagtctgggaggtgatatgttatttaccttgatttagccatttcataatgtatacatacctcaatcacatcatgttgtataccctcttgtacataatttttgccaattcaataaattcaacaactccaaaaaacaagacattctctttacaaaaataattgttaaaaataaaattcagaattctattttatttatttatttatttttgaaacagagtctcgctctgtcacccaggctggctgaagtacagtggttccatctcggctgactgcaacctctgtctcccaggtgcaaacgattctcctgcctcagcctcccaagtagctgggattgcaggtgtgtgccatcacacctggctaatttctgtatttttagtagagacagttttgccatgttgaccaggctggtctcgaactcctgaccttaggtgatccgccagcctcggcctcccaaagtgctgggattacaggtgtgaaccactgcacctggacagaatataaaagattgtttaattcaactaaaacattaaaacacagattatttctataagtggtaattgttctaacatgttttggtcaaaatagtctccttacttatccacaattaaatggttaattgatatttgattggatttttataaagttttcaaatcatgattcacttttccaatgtacagtaaaatgtgtttgaaaatattgcataaaaattaatatttaaaaatggtcaggcatggtggctcatgcctgtaatcccagcactttgggaggccaaggtgggccgatcacttgaggtcaggagtttgagaccagcctggtcaaacctcatctctactaagaatacaaaagttagtcaggcatggtggcacgcacctgcattcccagctacttgggaaactgaggcaggagaatcgcttgaacctgggaggtgggctccccaggcttaaagcaaaacccccatcttgtctgtctccactctcatcccaggcaatcgccgtcatttccacagcctcaaccactgtctacctgggatgcatcccaagcccgggtcgccagcccaaacctgccttcctagccccagacccatctgtcctggcacacattgccccctgggtccccagcaacctcagccaatgagaccaatgccaacttcctgtccttgcctgacactgtcagccctgagatcagacttgaccattcacctccagtacctgataggtccatcagtcctttggaacatatcccacgaaaattccccaaaccaggcaccggactccacacatcaacaccgtcacgtgagtcaccagcatccctggcagggacccctgtcccagcctccaactcatctccttcctgtcccttgagttctgtgtcacattccagaggccacaagaagaaaaatgaccaccttaatgaaattaaaagaattgagaagacatttctctatggtccaaaatctttccaactgagaaacacatatcaagatccagcctgctggccctgtggttaaatgttcctgaaataattaaagcccagggcaacacagcccccactccacaagtactcccagcacagtaagacttgcttctctacaggggcttgaaatgtccagtgtgtaccctgcccctctctgtcgtagctaacaggaatgtgctccgtgtcttcttcctgctcaaaggaccgtccaccaacctgcgcaggcagcactttcggcaaggggaggatgggagaacatcctaccatttcccacttactcactgcattcatcaggagcctgcctcacaaattacaagagcgccacggcagacccacgacgttccagcgggtggccatgtcttcatgtcaacttgaaagatcatcgccagggaaatatctatatctcggcagagaacttcagcctgtgtagtccagctgtgctcaaatggaaatccaaaaacccagatgttggtcaaaacaccctgtctcagggagctggctctgcaggtccccagtgtgagagtgaactgggtgggccacctgacctgtctacccacatcccggcctcctggaatcctggaccctgagaaccagggggatgtggtggggagcaggcaagtcttgtgcagaaagccaagatgccacccaaatccactctgcagtctaggagggcgatattctggtctgcaccacaccagtgcacgagaggatggaggatggagtctagacaagccaaatgtaaaaatatattgtccaagtattttgtgctttgtctgtgttacaatgcgatgacaagcccagtgtgctggctcacacctgtgatctcagcaacttgggaggccgaggcaggcggatcacctgaggtcagaagtttgagatcagcctgcccaacatggtgaaaccccatctctactaaaaatacaaaaattagccaggtgtggtggtgggcacctgtaatcccagctactctggaggctgaggcaggagaatcacttgagcccaggacgtggaggttgcagtgagcagagatcatgtcactgtactccagcctgggcaacagagtaagactctgtcttaaaaaaaaattaaataaataaaggctatgcccagtattttccatgtactgtcttattatctcagtaaatcccatataaccttcctatgaaagtgtatctcatttatctccattttatagatgagaaaactgaggcccctggagtagtattaattttccaagacagcattgctcataaagggtacagcagggacccaagctcgacactctcaccctcaaacatttccacaagtgtagaccaatggctctcaactgtggtggttttgctcacgtaccactcccttgccccacagcattgaaaccatctgcagacatctggggtagccatagctgggagggtagaatggcacctagaggatggagaccacagatgctgctaaccgtcctacaatacacaggatgcccccccaccaccaccacgaatggtctcaccccaaatgttgtgactgtgccaaagctgagaaatccaggtttctcctcagcaagaaggaaaatacctgcaacgtggatgcacctctacaggagcctcaggctgacaataaccttcctgatctggtttcaaccctggatgcttttacctggtgcgtccatcagggatttcagggactccagtgagttatcaccctcgaatgctcggttctgcctgacaacccagaaatctctgccaaggtgcctggtcttggggaaggctcagcaagcagttgaggttgacaaccaaatacctaggagagacttttctctccctccaggaggagctgtgggtcagacacacactgggatcattcacaagcggtcaataaaggcttggggaggggcagattttctaggccttctcaatggggtgggtgtttgtggatacacaagaagcctgtgaaacttctgatattggcaggaaatcaatgcccccatcctccacccccacccccacctccccaccataaacacatgccctgcagcaggacttgacactcaggggctcctggggtcccgatttatctgctaaaacctcctctagccaccaccgaataaagcaaccccttgcgacccaaccacaagagcactgcctggaagcaactccaagggacatccagtcacattaaaacctcagccatccagagcaccaggcctggtgatgagaaagaacattttatccttaaaagcatctgaatgcccatgctgcttcttgcagagaaaagtccaaaataatctgttattaaagaacgaggatggttttgacatttttaccaagctagtggtctacgcagacaaaatctcataaaagggcactctgttcttcttgatccactcagacatggcctgtgagtgaagaaacgggctctcctcctcaaagaaatcactgctgatcctcgtaccagcctgacactgcttcatgggttcttcaaagagagtattcccataggaactaaaagggaagaggaatgtgtctggcgggcattgtgggcagcagcgagctttgggccaaattttaagtttgaaaatcaagattccctcttttcaaggggctgccggactgagcagatacaggcaccgtgaaaagagggtgccatgttcagattcaggaaacaaggatggtttctattcagttcatccatcatccttcaggtcatgctattcccatttccctctgtggaccaaaaaattcagcggggtttctgccttttaaacatttcattatcaacatatcatccttttagcctccagaaagcattttaacatggagattctggcttaagactcttgtgggtctgtctgtctctctctctcttttccttgaaacggtctcactttgtcacccaggctgaagtgcagtggcgtgatcacagctcactgcaacccaaccttccaggctctagcaatcctcccacctcagcctcccaagtacttgggactgcaggcacacaccaccataactgcctttttttttttttttttttttttttggtagatatgaggcttcaccatgttgcccaggctggtcttaaactcctgggctcaagtgatccccccctttcggcctctcaaagtgctgggattattggcttcagccaccatgcccagccaaggaccttgtctcttgtgaagtactccagaacaaaacatcactgcaaaaacacatcagggcatgagttttagtcttaagtcccacttatccaccatacactatgtgccaggcacaacgctaagtgcttctatggacgagcttcccttaatctcagcagcaacaaccccaggcaatggagcctgttgacagatccatttgccactgaagacagtaaggctcagacagggtaagtggcttgtgccatgtcagccagctaaggaggggcagaaccagaatgcaaaccccagccacctggctccagaatcgcgttcccaaggtctcactacacttggtcactccaccgcattctggtatcctggtctttggcagagtccacgtaaaagagggaggtagagggagtgagagggacttcatgcaataaagtttcccggcgttacactgccaccataattgtgtccccgaccaggacctctcccttctcatcctttccgtgatcggccctggaaaaccttccaaagaactgtcctccttctcccgggatctcagagaaaattcacctgagttcagtgtccaggtgacccaagctctgaatgcggtaacgtggatggggagaagaggatgtcaccatgagcaagcctcccagacagcatccaggagcaaccccaagactgggcgggggggctctgatgccgcccacggcgaggagggctgcccatgctgcctaaatgggttcagaatgaagaccgccctctctcccatgtggggctcattaaccatgaatccaattattaagacaagctcagctgagcaaatggtcaaacataaaaacatgtggaaggaacaaagaggtcaaccccattatccattaaaaaccatcaaggtggcggccctcactgaggggtacagttctccagctggccctcatctgccctccaaacccacatgcctccccagtggaaggccagcaaagccacacaggaagagttggggtaggaaagcagaaagtgaaccccaggaggccagcctggctacgcagccccatcccacacacactggcccggtgattcaggggccaacgtttgcaggacaccgggagctcacagggacagcgccccggggatgcaaggaactttgcctctctgtccctctctgtagggatggaaagaggagagcgatttctgggatggaagccatctgcctcctctcaactcttgctgcccaaccagaaagggaagaagaacaggaagatgcgggacaggtgaggagctgggtgagcgccgccagcccgcagtccagccgagcagggcttggccaagcctggcgccagggacttcccccctacccccaccactggcccctcgccaggtgagaggcaccgacagggtcccagacagatgccccagacaggatgcccagcgcaacacccgccacttcccctgctaggggcccccaggacgcggggctgcccctctctttttggccagccgcagagtccagtgggtctcccagccagggacgtcgtgggagaatcaggaagtcaaagccacacagccgagaagcggcagctggcatctcggaggccgtcacgcgctgtcactccgcgcccttcggagttgcagctaaaataccaacttcaacccggggccggccacggagcctcccgccgcccctaccggcgcccccggcacccccggaccccagcgcccgcgtcacttactcctctgcggtcgccacctgtctgggtgccggtctcctccctgcctggccgcggcgcgtcctccccgttctcgcagtcctcgggctgtgcgcttcccctctccagctacagccgcagcctcttctcttccggagggacgtcgtcctcctccctcctgggccggccatccctgcctcggggcttgccagtggcttcggagctgccggaagggctggccatggctcgggggctctgcctgcacctggagaagaggaaggatacggcgcgagcggcctctcggcggagctggggcgtctgagcgcgggctcggtgggtccgcgcggcgcggagctgggtataggggccggcgcgggctcctccgcgggccgcgcctggctctctggcgccctcttctggccgctctcgcgcacctccgccacgccgggcccaggcctgcgcagctctcacatgtcctggcccaggaggtcgctgtcccttgcccatggacaggccctctctggcaatgccctgcacctcctccccaccccggccaggttggaccccgatggtctccctgctcaaggaggagagaagagaagggacgccacgagagggtggacatcggccaaagccaccttgtctttgctcttaccctgtgtcttccatgatttggaggtggtgggaaacccgaggctgctcaaaactcgtggagaattcctcctgcaggatgacatgaatgcaccttcccattgcctaccaacagatcttttttgagcatcactgtggaccagtcgtggtgatgggggaggggatattgtggagaacatgacaggcattgccttcacccagtgaggctcagctctgggtgggaaggcattgagaatggacattgtcaactgggccaaaggaggccaaggagaagtgctgggggcatgggaactgaaaaagagaggaggctcagcacgtctttgagctgggagagggacagcagcagcggcttttccaaaggaagcaacagctgagagaggtctcagagagttgttctcagcccagtggagggtgttcaggcagagggaacagcgtgtgcaaaagcccagaggctgggaaagaagcagaaagaggactgtggggctggagcatggtgggcaaggggaggaaggtgtggtgggcagacagattgcctgggacccagccgtgcaggggcagaggagatacgggatccttgcaggcccccagccggggctcaggcacagagacagtgcaggtgggcaaagggaggagacgtggagaaatattttggaggcatgccctgatgaatgagcccaggatgcacccttagtgtcagtgtggagctccttccttgactgtgtgatgagctgaactcgggggtattttctggacattgaggtgctacaccaagagcccaggacaggctaagtgagcactagcagctcctggcccacctcaaaagcaggagagacaggggagactgaggaggccggggcggaaggggaagccaggaaggtaggagaggccagggaagcagaggaggcccgggaggcaatggaggcaggagaggctggggaggttatgtcctttccatgattctgccctcgatcctaggcccctgaactccctgagcttccccaccccaagcgctggaaccatgttgcacaatggtctccccactaagctcctgatggcagcccctaccctgctgtgctccctgtttcaaccctaacagctctcacagtgggcagcacatagtaggtgctgaggaaacactggtgggagagcacgtgggtctgctcagcaccttcctctctcctccagctctcccctgtcacgaaataattctgataacgacacatggactttgagaccctcttctattactttccatatgctaatccatctatacctcacagcagccctgggggtgggtgcaatgaggatgcccattttatagaggaggagactgaggtataaagagggtaagtgacatacgcacactacaggggctggggtcaagtgatcagagcactcaatccccaaaggcaaggtggatgcagttaccataaaagacagcagagtcaaagctgcaaccagaatagcctgactcgcagcgacctatggtgcctgttgatcctggctttcctagaagtgaaatagataagaagcctgccacatttttactggaactgtgtttgcagaagtgttctaggtcaagtgagcagaagtctaatctgattaataaaaacagagtcacagtccccggtcaatttccagacataagccagttcacagactcggagtcccttgtgtgaatgggaagccaggtcccctccagaaaggactctgctacactgccaaaaatttatactgtcaatctttctcccagcctgctcccaagggaataaacagccttttgctaggatgactgaacaggagaaaaggaactaatggaacctgtgcaggatcactggacacaggctctgaactggcactaggatgagactagggtctaccagtcagaataggcattttgaaggtcaggtgaatgttggtgcaagttcatgtcacggtaggtccattgggtccccaaatccatcctctggttatatacaaagcggcaatgctgagattcaaattcagggcatccaacatagaggctgggctcttattcatgaaacattctgacactagtaaccaatttaaaaatgtaaacacctcctggggctagccagagtcctccaaacagtcatgtaaattggttctgtcaaggatttcctcccacccactgctgagagccagttgcaaggagagactagggaagggcattgggtaactttgttgctaaaagctcttctggataaagacatttgggaaaagaagcaaatagagttcagcagaagaggtaagaaagtaagtttatgtttggccaggcacggtggctcacgcctgtaatcccagcacttgggaaggcccaggcgggcagatcacgaggtcaagagatcggactatcctggccaacatggtgaagccccatctctactaaaaattcaaaaattagatgggcatgatagcgcacgcctgtagtcccagttactcgggagcctgaggcaggagaatcacttgaacccaggaggtggaggttgcagtgagcggagatcatgccactgcactccaacctgggcaacagagtaagactctgtcttaaaaaaaaattaaaataaataaatgctatacccagcattttccatgtactgtcttattatctcggtgaatcccatataaccttcctatcaaagtgtatctcatttatctccattttatagatgagaaaactgaggcccctggagtagtattaattttacaagaccgcattgctcataaagggtacagcagggacccaagctcgacactctcaccctcaaacatttccacaagtgtagaccaatggctctcaactggggtggttttgctcacgtaccgctcccttgccccacattatttgaaaccatctggagacgtctggggtagccatagcagggaaggtagaatggcacctagaggatggagaccacagatgctgctaaccatccttcaatacacaggacagccccaccaccagcaccacgaatggtctcaccacaaatattctgactgtgccaaagctgagaaacccaggtttctcctcagcaaaaaggacaatccctgcaacgtggatgcacctctacaggagccccaggctgacaataaccttcctgatctggtttcaaccctggatgcttttacctggtgcgtccatcagggatttcagggactccagtgagttatcaccctcgaatgctcggttctgcctgacaacccagaaatctctgccaaggtgcctggtcttggggaaggctcagcaagcagttgaggttgacaaccaaatacctaggagagacttttctctccctccaggaggagctgtgggtcagacacacactgggatcattcacaagcggtcaataaaggcttgaggaggggcagattttctaggccttctcaatggggtgggtgtttgtggataaacaagaagcctgtgaaacttctgatattgggaggaaatcaatgcccccatcctcccccctcccccacctccccaccataaacacatgccctgcagcaggacttgacactcaagggctcctggggtcccgattaatctgctaaaacatcctctagccaccaccgaataaagcaaccgcttgccacccaaccacaagagcacagcctgggagccactccaagggacatccagtcacattaaaacctcagccatccagagcaccaggcctggtgatgagaaagaacattttatccttaaaagcatctgaatgcccatgctgcttcttgcagagaaaagtccaaaataatctgttattaaagaacgaggatggttttgacatttttaccaagctagtggtctacgcagacaaaatctcataaaagggcactctgttcttcttgatccactcagacatggcctgtgagtgaagaaacgggctctcctcctcaaagaaatcactgctgatcctcgtaccagcctgacactgcttcatgggttcttcaaagagagtattcccataggaactaaaagggaagaggaatgtgtctggcgggcattgtgggcagcagcaagctttgggccaaattttaagtttgaaaatcaagattccctcttttcaaggggctgccggactgagcagatacaggcaccgtgaaaagagggtgccatgttcagattcaggaaacaaggatggtttctattcagttcatccatcatccttcaggtcatgctattcccatttccctctgtggaccaaaaaattcagcggggtttctgccttttaaacatttcattatcaacatatcatccttttagcctccagaaagcattttaacatggagattctggcttaagactcttgtgggtctgtctgtctctctctctcttttccttgaaacggtctcactttgtcacccaggctgaagtgcagtggcgtgatcacagctcactgcaacccaaccttccaggctctagcaatcctcccacctcagcctcccaagtacttgggactgcaggcacacaccaccataactgccttttttttttttttttttttttttttggtagatatgaggcttcaccatgttgcccaggctggtcttaaactcctgggctcaagcgatcctcccccttcggcctctcaaagtgctgggattattggcttcagccaccatgcccagccaaggaccttgtctcttgtgaagtactccagaacaaaacatcactgcaaaaacacatcagggcatgagttttagtcttaagtcccacttatccaccatacactatgtgccaggcacaacgctaagtgcttctatggacgagcttcccttaatctcagcagcaacaaccccaggcaatggagcctgttgacagatccatttgccactgaagacagtaaggctcagacagggtaagtggcttgtgccatgtcagccagctaaggaagggcagaaccaggatgcaaaccccagccgcctggctccagaatcgcattcccaaggtctcactacacttggcctctccaccgcattctggtatcctggtctttggcagagtccacgtaaaagagggaggtagagggagtgagagggacttcatgcaataaagtttcccggcgttacactgccaccataattgtgtccccgaccaggacctctcccttctcatcctttccgtgatcggccctggaaaaccttccaaagaactgtcctccttctcccgggatctcagagaaaattcacctgagttcagtgtccaggtgacccaagctctgaatgcggtaacgtggacggggagatgaggatgtcaccatgagcaagcctcccagacagcatccaggagcaaccccaagactgggcgggggggctctgatcctgcccatggcgaggagggctgcccatgctgcctaaatgggttcagaatgaaggctgcactcccaacttcaacccggggacggccacggagcctcccgacgtcccttcgtcgcgtccccggcacccccgcgcccctggcactcccggacccccgcgcccgcgtcacttactcctttgccgtcgccacctgtctgggtgccggtctccttcgtgcccggcagcggcgggtcctccctgtcctcgcagtcctcgggctgtgcgcttcccccctccagctacagccccagcctcttctcttcgggagggacgtcctcctcctcctcccttctgggccggccatccctgcctcggggcttgccagtgtcttcggagctgctggaagggctggccatggctccgggggctctgcctgaacttggggaagaggaaggacacggcgcgagcggcctctcggcggagctggggcgtctgagcgcgggctcggtgggtccgcgtggcgcggagctgggtatcggggccggtgcgggctcctccgcgggcggctcctggcactctggcgccctcttctggccgctctcgcgcacctccgccacgccgggcccaggcctgcgcagctgtcacatgtcctggcccaggaggtcgctatcccttgcccatggacaggcccgctctggcaatgccctgcacctcctccccgccccggccaggttgcaccccgatggtctccctgctcaaggaggagagaagagaagggacgccacgagagggtggacatcggccaaagccaccttgtctttgctcttaccctgtgtcttccatgatttggaggtggtgggaaacccgaggctgctcaaaactcgtggagaattcctcctgcaggatgacatgaatgcaccttcccattgcctaccaacagatcttttttgagcatcactgtggaccagtcgtggtgatgggggaggggatattgtggagaacatgacaggcattgccttcacccagtgaggctcagctctgggtgggaaggcattgagaatggacattgtcaactgggccaaaggaggccaaggagaagtgctgggggcatgggaactgaaaaagagaggaggctcagcacgtctttgagctgggagagggacagaagcagcggcttttccaaaggaagcaacagctgagagaggtctcagagagttgttctcagcccagtggagggtgttcaggcagagggaacagcgtgtgcaaaagcccagaggctgggaaagaagcagaaagaggactgtggggctggagcgtggtgggcaacaggagagaggtgtggtgggcagacagattgtctgagacccagccgtgcaggggcagaggagatagaggatccttgcaggcccccagctggggctgaggcacagagacaatgcaggtgggcaaagggaggagacatggagaaatattttggaggcatgtcctgatgaatgagcccaggatgcacccttagtgtcagtgtggagctcctttcttggctgtgtgataagctgaacccgggggtattttctggacatcgaagtgctacacccagagtccaggacagactaagtgagcaccagcagctcctggcccacctcaaaagcaggaaagacaggggagactggggaggccggggcggaaggggaagccaggaaggcaggagaggccagggaacagaggaggtcagggaggcaggggaggcaggggaggctggggcggctgtgtcctttccatgattctgccctggatcctaggcccccgtactccctgaccttccccaccccaagcactgtaaccatgttgcacaacggtttccccactaagctcctaatggcagctcctatcctgctgtgctccctatttcaaccctaacagctctcacagtgggcagcacatagtaggtgctcaggaaacactggtgggagagcacgtgggtctgctcagcaccttcctctctcctccagctctccccatcatgaaataattctgataacgacacatgggctttgagaccctcttctattactttccatatgctaatccatctatacctcacagcagccctgggggtgggtgcaatgaggatgcccattttatagaggaggagactgaggtataaagagggtaagtgacatacgcacactacaggggctggggtcaagtgatcagagcactcaatccccaaaggcaaggtggatgcagttaccataaaagacagcagagtcaaagctgcaaccagaatagcctgactcgcagagacctatggtgcctgctgatcgtggctttcctagaactgaaatagataagaagcctgccacatttttactggatctgtgtttgcagaagaattctaggtcaggtgagcagaagtctaatctgaatcataaaaacagagtcacagtcccccgtcaattcccagacataagccagttcacagacctggagtcccttgtctgaatgggaagccaggtcccctccagaaaggactctgctccactgccaaaaatttatactgtcaatctttctcccagcctggccccaagggaatacacagcctttaccgggatgactgaataggagaaaaggaactaatgggacctgtgcaagaccactggacacaggctctgaactggcactagggcgagactagggtctaccagtcagaataggcattttggaggtcaggtgaatgttggtccaagttcatgtcatggtagatccattgggtccccaaatccatcctctgcttatatacaaaatggccatgttgagacttaaattcagggtatccaacttagaggctgtgctcttactcatgaaacattctgacactagtaaccaatttcaaaatgtaaacacctcctggggctagtgagagtcctccaaacagtcatgtaaattggttctgtcaaggatttcctcctacccaccacccccaccactgaaaaccagttgcaaggagagactagggaagggcattgggtaactttgttgctaaaagttcttctggataaacaagagccttatccaggaaaaagaagcaaaatagagtttcagcagaagttgcgaaaagaagcacatagagttcagcagaagaggtaagaaagtaagtttatgtttgaccaggcacggtggctcacgcctgtaatcctagcactttgggaagccaaggcgggcagatcacgaggtcaagagatcgcaccatcctggccaacaaggtgaagccccgtctgtactaaaaattcaaaaattagctggccatgatggcacacgcctatagtcccagctactcgggagcctgaggcaggagaatcacttgaacgcaggaggcagaggttgcagtgggccaagatcatgccactgcattccaacctggtgacagaattagactccatctcataaaacaaaacaaaacaaacaaaaaaaagtaagcttatttttaagcctgaacaagtgtagtggtttaggggttctgcaaacacggccccaatcaggctacaagatgttctggcagcaatatttacagccagtcactcctggccggctgagccacttttcaaaacacccttgcacggctgtgcagagaggctggctccactggcagccggcagagccataactcacagtgtcaccgctgccctcaaaccacttcggtaagcactttgtatttttgagacggagtcttgctctgtcatccaggctggagtgcagtggcacaatctcggctcactgcaagccccgcctcctgggttcatgccattctcctgcctcagcctcccaagtagctgggactacaggtgcccgccaccatgcctggctaattttttgtatttttagtagagacggggtttcaccgtgttagccaggatggtctcaatctcctgaccttgtgatctgcctgcctcggcctcccaaagtgctgggattacaggcgtgagccaccgcgcccggcctggtaagcacttttaatcaatgcaacaggaataaacatttgctgcagagcggcaatttgcagggaagaacatgcttccacttaggatcagaaagcaaaacctcctggctgtttgcatctatgcaagagctcacaggaaaagccctctgtgtggctgccagcctcacacactccccacaaggggtgagtttctctttccatgttaatctatgctctgacgtgccatctgtcaaccaccacaccattctcagttgacatttcaaagcatctttgccctgagaatggtcaccagctctgccctgcaagcccccaggtgacaatgaacttaaatgagagagaaaacaggtttcgaggtggatttcagttcagcatcttggagtctctgtgtggacatgaaatctgtctccccagctgtggactgcatccttgtttgtcatctggtttggttcttggggacttggaaactcgtgggcacctttgcaatttgtcaagaagctgcacggcccttccaacaaaagcaaggaataggaacagaagcccaaggcttcagatcaaggtgcaatttaaagcagcctcagtataaaagcaaacaagagccagagggatgcctaagggagagtctagacctcagggcagctataaggcaaagagaaagagagagagagagacagagacagaaagacagagagagatgggaggagacatgaggcacccaggcatctggatcaaaatccctacaagaggggcctcctaaaaattcaggaggctgaggtgggtgcacacagaagttcaagactagcctgggcaacatagcaagaccgtgtctttacaaaaaatacaaaaattagccgggtgtggtggtgtatgtctgtggtcccagttacccaggaggctgaggtgggaggattgcttgagcccaggaggtagagctgcagcgagctgagatagcaccactgcactccagcctgggcaacagagtgagacttcatcacaaaaaaatttaaaaaaatttttaaaaaggatcaccccggctactcgaatggttaataagaaggtaagagcagaagcaaggagaccagcagggacattctgcaggtgggagtccacagaggctcagaccaggctggggctgaagactgcctgaattctgtgtatattttgatgatgaagaaactcaccgactcttgaagagtgggctccaggagatggtatttttaacaagctctcagagtattctaatgcaggctgaagttgaagaactggtttaggtgaagcttctgtttcatccttggggaagtacctactgacttttctctaagccaccacaaaagaggtgctagacaagatgtgctccaatgtctgaacatgtgtgcacagctgtagagccaacctaaggacactgagtcaaaggttaggagtacaacagtgaacaaccactgtcctcttttcaataagctttgcatttaatgagagaaaaaaaagcaaaaaaaaaaaaatcattttcaactcagaatggtaagagttatggtgacactatgcctggggcaatgggagcacatagaaggggcacccaatcggccaggtgcagttgttcatgcctgtattcccagcacttcgggaggccaaggtgggtggatcacttgaggccaggagttcaaaaacagcctggccaacatggtgaaatcctgtctttactaaaaatacaaaaaaattagccagatgtggtggcgggcacctgtaattccagatactcagaaggctgaggtgggagaattgcttgaacccgggtggtggagattgcagtgagccaagatcgcaccactgcattccagcctgcatggtcagagcgagactctttcaaaaaaaaaaaaagaaagaaaaaagaaaaagctcggaggtgggtgggcatgcaatctatatcaggtggtgagaaatccttctccaccacaggactcctcagttgaagactagaaaatggaaggaactagccaggttgataggagaggtgtggaagatcattcccagcagagggaagagcatgtgtaaaaatcgagacgtggagggtgaggagttgagagatgttcatataattgtaaaaagtgactaatatagaggtaagttggaggcaaatcttaaaggctctttgtcgtgtctatcctgtagacaaagggagacagtagatgtttttatgcaggggagtaatgatccactttgtgctagaagaagagtagtctggctggaggagagtgggtggtgagtagaccaggtaggaggctgcaatacgccaagtgagacaagatggttggctggaccaaggctgtggcagtgaggatggagaggagacagtagactaacttgactgagaaagagggaggaatgaaggaggaggcccaggtgatttggaagctgggtggatggtggtgtgaatctgacgtggtgagccctggcagaagaggaaatcaggagaggaaaggtaagatgaggtcaatgcaagacagacagccaagtggagataacaactgggcagctggattcatcagcctggagttatacagagagctctggaatggaaataaagaggaaaggactttgggaataggtgaatcctcccagaataatgtgtaagaaaggagaatagaacacaggggacagaaaaagggaagagatttgttattaaaaccaaccatccatcagacatcttccaataaaacacttgttagaggtttcctcagtgtgagttattcaggaccagagctaaagaccatattcccaataaaataactgctgggaaggtcttcatgaaaatatttaatgctgcttttaaaacaacaacaataaaaaggctttagctactgcacagaccctggagcaatttttcagcaagtgtctatcaaacacgaatctgatctgactcaaggaggtgtcatatcaagtgtaaaaatccaattccaatgtccataagagcctttctgccaggtacaagaccctaatccagttgaagtgattttctattgattaataggctgggaatacacaggttgttggtttttgagatttccctccctgtgccttcatgccagctgtgaaagagtcaaaaggctcctaactgtcaaaataaaaatgacacttcgtcacagaggaagcagattataggtcaatcacattgatgactttttaactatgagaagccattaatgttactgaataagcaaatctgtttgcataagcagatttttataggctactgggaataaaggttttcctaagtgggtgatttgtacaacgatagcctttgggtctctgatggaacagctctgacgaggaaatgttcctttaattatgtggaaggccaattaccacgttatagccacattgttttgcagattgcatataatttcaccatttccatagcttcagcacgataattctggagaaaattcaggcaccaaggagacacttgaggcacactatgctggagacagatgttttagcgaattcagtttaagcttcaacattaaagttattttgttgaataaaacataatgcaataatgagcttgtgtatgtcaactctatagtgcaggtaataatagctagagagagcatgtcccgtctcctctttttaatgctcatttgagtaatacataatgctatagagagaacttttctctaatatgtgcttcacctcaggctaagcgtgttttgggcaactgtgcttcatgaaaaaaaaggtaaaggatctaatttgggagccactcacaaaagtgttaccacttgatgtttttttatactctgagatttcttattcccagtgcctaccaggaatggactttctggagaagctcagattaatcactccttatgagaggtaacagcgtgctggcagccctcacagccctcgttcactctcggcacctcctctgcctgggctcccactttggcagcacttgaggagcccttcagcccacggctgcatggtgggagcccctttctgggctggccaaggtcagagctggctccctcagcttgcagggaggcatggagggagaggcatgagctggaactggggctacgtgtgctgcttgcctgccggctggagttctggatgggcgtgggcttggcggccttgcactaggagctgccggctggccttgccggcccgggccgtgaggggcttagcacctgggccagcagctgctgtgctcgacttctcactgggccttagctgcctccctgcggggcagggctcgggacctgcagcccgccattccttagcctcgcccctctgtgggctcctgtacggcccaagcctccccgatgagcaccgccccctgctccatggcacccagtcccatcgaccacccaagggctgaggagtgtgggtgcatggagagggactggcaggcagctccacctgcagctcctgtgctgggtccactgggtgaagccagctgggctcctgagtctggtggggacttgtagaactttatgtctaggtaagggattggaaatacaccaattggcactctgtatctagctcaaggtttgtaaacacactaatcagcaccctgtgtctagctcagggtttatgaatgcaccaattgacactctgtatctagctactagggtggggacttggagaacctttgtttggacactctgtatctagctaatctagtggggacgtggggagcatttgtgtctagctcagggattgtaaacgcaccaatcagtgccctgtcaaaacagaccactcaggctctctgtaaaatggaccaatcagcaggatgtgggtggggccaggtaagagaataaaagcaggctgcccgagccagcagtggcaacccactggggtccccttccacactgtggaagctttgttcttttgctctttgcaataaatcttgttgctgctcactctttgggtccacactgactttatgagctgtaacactcaccgagaaggtctgcagcttctctcctgaagccagcaagaccatgaacccactgggagaaatgaacaactccagacctgcagccgtaagagctgtaacactcaccgtgaagatctgcagcttcactcctgagccagcgagaccacgagccccacctgaaggaagaaacttcaaacacatctgaacatcagaaggaacaatctctagacacaccacctttaagaactgtaacactcaccaggagggtccacagcttcattcttgaagtcagtgagaccaagaacccaccaattctggacacacttatacacttggcactgggaggtctgtatggagcaagtgaagaaatcagcagagtgaagatagaaggagaacaacatgatgggggaaaggcaaagttagtgccacattggtttcaattctgccactcatgagtgagacccgtgacctcctctctctaagactctgttgttcttatctgtagagtggaggaatagaaggaccttttaaagtattaacatttcctgacctatctgtaaaacactttcattcaaactgatgggaatcttgactgctttgccaagagggcataataatcatcaagctgaatgcaccaaacagcattgcctgaaactatctaagcaaaatctgagaaagttacacaggacagacaaacctcctatgagagtaagaactcttcagcacatgcttagtgtgtcaaagacaatactgtgttcacaccattcctcttcctggacatgcagaaagactacatttcccagcctcacttgcagttagtttggaaccatgtgactgcatttccaccaataggaatgtaagaaatcacttctgggccaaggttatcaaagtgtgagctatgttccctctcttcctattcatatggctacaagtgaaaaactctgagatggcagaattaaaagatggaaacctgcagaatctctgaatcactgttggacaagggcccccaaagagaacccctaccctgcaccagactatgctatgggtgtcaacccactgagagttcagggtttattcgtctcagcagcagtctattgttacactgactaacatcctgaggtttgagaggtctagcatattgttaactgaagttagatttcaattacactgagaaccttatctatttaaaaataaaaactctcctaaaaaaaaaatccacattccttttaaccacatgtggcaaatttgcaaaaaaaaaaaaaaaaaaaaaaaaaaaaactggccacatattaggccataaataagtctcaacaaaatccactatacgattgacagtgtccagagcacattttcctgaccataatgccacaaaattagaagtcaacagcaagaagatagctaaacgcaagcatatatttggaaaattaaaaatatcctttcatgagttaaatgaaaaatcataatagaaattactaaacatttacaactgaatgaaaacacaactttatatatatatgtatatatataatgtgtgtatatatatatatatatatatatatatatatatttttttttttttttttgtgagtcttccaaatttgttcttcttttacaaggttatttgggaaattctgggtctcctgcaattcctcttacagttttatgctgtgtgtcaatttctgtggctgggtctatgagaacttattgtagttctcatagaccagggtttgcatgttgctgtctagagccctgatctgctgcaccatgtccgtctcactatccatcagctgggccagagggcactctctaggaagcttgtctaggtaaacttccgggtcgaagtgcaccccgttcagatcagtggggtccaggggttcggtccccgcggggagtcccaccgcctccacttccgagaggccgttgtaaaacttcagcatcctgtccgccttccaccgacgctccttgagcctccccctcgggcccttctggggagtccccaggtccacaccccgggctaggcccagtgacagctgccgccgccatagctccaactgcagcccacgggcgtaacttttatatttttaagttggatacatggagctacttggcttttgctttcatcacctcgttgaggaaagagctggttgcttatggtacccctgtttttactgcaacgtgtaatggatgagaacctccctgttgcagagagcaaaacactgaactaaattgtgctgtaacacagctctgtattgggggagtgggagtgatcatgcaaacgcttgcaaatttgcacagtgacagagacaatcgtttgggcagctgttcactatatgaaaaggcaattgaccaaaagtcagttactgagctatctcaatactttcattttattttaacttttggcagcagggtgcaattaaaggagagaaagaaaacaaagtgataagtgtaaaataatgtacacacatgtgtaaaagaaaatgacaagacaggatgactatttgtctcttggttagctccttgggctctatgtctccttcctcggagaacctcgttttcctttgcccagatttgttagggtggataatccaggcgcctgctcccccatgatggaagccaaagacgtccctggagcagcgtcccgctgcatcctttcctgcactgcccacatggacacaactcagccgattagtcttcctctcagaactttagtcttgagcaaagggattaaagggtgaagtgactgaaggtatgcccttccaaagtggtacgtgagctaatggctaaagtttgccaagcccatccaagcactttttttcgtaatttttatttatttatttttttgagacggagtcttgctctgttgcccaggcaggagtgcagtggcgtgatctcgattcactgcaacctctgtctcccggcttcaaaggagtctcctgtctcagcctccccagtagctgggatgacaggcgtatgccaccatgcctggctaatttttttgagtttttttggtatttttagtagaaacagggtttcaccatgttggccaggctggtctcgaaatcctgaccttgtgattcgcctgcctcagcatcccaaagggctgggattacacacgtgagccaacgcgcccagcttcaaagagttttaagcagagctcagaggtcttaaccacaggcacatcggaggagcatttttgaaacactttccatcttcctcaataggaatggaagccaaactccgaattgatgactcctttgaggaagttgagagctgtaaggaaagccaggaacaggggcaagggagagatgcgtcccgaatgatcctgtgcaaattctttctggaatccttgatgtgatctcagctgccctttctatacatgacacagtgattgtggcacccactggtctagctgtggtctacaaggaacccccaaagggaagggcacagtgagcaggggcatccgcctgagtgacgaggatttgagagggcaggttggttgcagggagaggacttgccaaatgacatgtgtctggacttagactgcctggttcaaattggacttcaccctttttgacttcgtgatctggtacaagctacgtgaaaatccgttgagctttttctagtctgtaaaatcatcatgaaatgtgcactaataactgggagactatgcagatgaaatgaaacaagctgcatagagcacagagctcagagcctggcctttaggaagccctcagtaagggttcatgatgccatggtgtctgtcgtcatcctctttatcctcatcatcaccttcataatctctttgttgttcttagggaatagctagaggggctgattccctgctatcatgggtgagatgtttatgagaaggacaaccagtgggggaggaaagcaaaattttgaataagatttctgagacccccagcacaaccaagaacataaactgcacagtctgctgagcagagagttgcatattggtctcctcacatctgcccaccgcactctcctgtttgtcctgaggatgaggaaacaaacaagtctcccgaacgtccctcagcactcacttgaaggggtggcctcctcctccacagctgtgggtatttccagtcgggtaggacgagagactgagaaaagaaataagatacagagacaaagtatggagaaacaacagtgggcctaggggaccggcgctcagcatacaaaggacctgcaccggcacaggcctctgagttcccttagtttttattgactattatttttattattttagcaaaaaggaatgtagtaggagcacagggtgataataaggagaaggtcagcaacgaacatgtgagaaatagaatctacttcataaggaagttcaaggaaaggtactatgactggatgtgtacgtaagccagatttatgtttctctccacccaaacatctcagtggagtaaagaataacaaggcagcattgctgtaaacatgtctcgcctctcaccatagggtggtttttctctcatctcagaattgaacaaatgtacaatcgtgttttataccgagacattcagttcccaggggcaggcaggaaacagcggccttcctctctctcaactgcaagaggctttcctctttgagtaatccacctcagcacagaccctttacggggggcgggctgggggatggtcaggtctttctcatcccacgaggccatatttcagactatcacatggggagaaaccttggacaataccctgctttcaagggcaggtctccctgcggctttccacagtgtattgtgcccctggtttattgatactagagaatggcgatgacttttacaaagtatactgcttggaaacatcttgttaacaaggcacgtcctgcataaccctagatcccttaaaccttgatttcatacaacacatgtttttgtgagcttcaggttggggcaaagtggctggggcaaagctacagattaacaacatctcagcaaagcaattgttgaaagtacaggtctttctcaaaatggagtctcttatgtctttcctttgtacatagacacagtaagagtctgatctctctttcttttccctacactcactgaactgcctctcccctctgctgggacatgaccacggagaacaggtccactgtcctccctgcgtggtgcaccatggaggctcagactccgtcctcaaggctggcaagaagacagggtgagacatgagcctcctgatacaggtgacggctgtggagaccacaggactgcaacctcacactgcagggctggaggcacagactgagtatttactatcctgtggcctggggggctcaggcacagagctcctcattagccaaagctgcccaagttccccaacctgtaaggatgtcctcacaataatgcaagaagaagaagagaaaagtgagtgtccatagaaactttggggctcctcctctaatcagaagaaagctggtgtgtattcttcgcttctttcttttctttttaaacatccaactgctttaattttcatcttttataatgggaaaatataccacgtataaatattaaaaattataaatatatattagttcatatagaatgaccagtataaacatttacaatttccactctttttcagtttacagattattgacattaagtacgttcacattatttagcaagcatcaccgccatcatctcaggaacagttttatctttcaaaatggaaattccacccattcaccaagctctccattcctttctctcacccacccctgggggccacctttctagtttgcaactctatgagtttaactactctagacacttgatagataagtggaatcataccgtgtttaatttttttgttttggagacagagtctttctctctcacccagtctggagtgcagtggcgtgatctcggctcactgcaacctccacatcgtgggttcaagcgattcttgtgtctcagtctcccgagtagctgggattacaggcttgcaccactacgcccagctaatttttgtatttttaatagagacgagctttcaccatattggccaggctggtctcgaactcctgacctgaagtgatccgcctggctcagcctcccaaagtgctggtgttacaggtgcgagccactgagcctgggcctgtttatccttttgggatttatttatttcactgacgataatgtcttcaaggttcatccatgttgcggcctgcctcagaagtgcctgtctgttttttttgttgttgttgttttttgtttgttcgtttgactttgttttgttttgtgtttccatggagtctcactctgtcgcacaggctggagtacagtggcacaatctgggctcacctccgcttcccgggttccagtgattcttgtgccacatcctcccgagtagctgggactataggcacacgcctccatgctcatctcattttttgcattttcagtagggacagggtttccccaagatggccaggctggtcttgaattcctgacctcaggtgatccgcccacctcggtcttccaagacgctgcgattacaggcgtgagccaccgcaccggccagaagtgcctgccttttgaaagctgaatagtcttccattgtatgaaggaactgcagtgtgctttttcattcatctgtccacgaacccttgggttgcttccacattttggctcttgtgaataatgctgctatgaatatgggtgtacacaaatctgtcttccactcctggcttcttttttgtaggtacccacaaatgcaactgcggcaacatctgatcatcctgtttctaatttttccagtagacaccatactattttccccgttccttcacggttttacattccctctgatcagattcgagcattcctacttccctctagtctcaccaatcctgtttgtttatcatatccatcctaatgtgtggtgtcacattcttggtttgatttgcgcttccctatgatgagtgattttgaacatcattttagatgcttattggccactgctatatcttctttaggaacacgtctacttgagtcttctgaccattgttgatgggatgctttgggtttcttgttgtttagttctgcctgttctttatgtatgatggatatcagcctcttttcagatatacgctttgaaaatatttttcctaatccatgggttatcttttcactcagtttgccgtgattttgctgcacaaaagtgtctgtcatttcgatgtaatccaaggaatctaattttcttttgttgcctatgcttttggtgtcacatcccagagaacattgcccaatctgatgtcatgaaagcatggccaatgttttcctttaggcgaatgattcttttagcgcttggggtgaggtctttgatccagtttgtgttaatttttgcccctggtgtgacatagggtccaccttcaatcttctgcatgtggaaatcaagtttctccaacaccatttcttgaaaaggctgtttttccaccaatgagctttcttaccactcatgttaaaaatcatttgaacatacaggtgacaagttatttctgggctccaaaataaacaaacaacagcagacaacagataatgttacagcatgggctgggcgcgtcgctcaagcctgtaatcccagcactttgggaggccgaggtgggcggatcacctgatgtcaggagttgaagaccagcctgaccgacagggagaaacctccgtctctactacaggcgcatgcctgtaatcccagctactcgggaggtggaggcaggagaattgcttgaacccaggaggcagaggttgcggtgagccaacattgcaccatgacactccagcctgggcaacaagagcgaaactccatctcaaaacaaaaaacaaaaaacaaaaaaccagcatgatttcaagagcagaaagagaagagctgaaaaaccagcataatgagaaaattaggaagtttcttaccaaagcatctggaaatattcaagaaattcttgtgaactaaaattttcatactgtacaatcaaacactagaactcacttattccatctttctgtattttgggacccaattatccacttgtcttcattccccatcccaacccttttcttcctagcgtctgctaaccacctttatactttccaccttcctgagattccttttgtgtgtaggtgtgtgatggagtctctttatgttgcccaggttggagtacacaggcacaatccgggctcactgtaagctccgtctcccgagttcaagcgcttcttgggcctcagccctccaagtagctgagactagaggcacgcgtcaccacgcccggctaattgtttgttttttccgtagagacggggtttcaccatgttggccaagcgggtctcgaacccctggactcaattgatccgtgcgactcggcctcccagagtgctgggattacaggtctgagccaccacgcctggtcaaggtttccttttttcttcctacgtagaagtgaggacatgaaatatttgacattctgtgcctggcttatttcatttaatatacagacctgcaatcacatccattttgtctgcagcagagaggattttcttcctctttaggctgaataatacttcattgggtgtgtataccacagtttctttattgaaacaaatttctaaagagcaaatatttttaaagtctcagaatgtgaaacttcagggataccgtgcccattttattcttttctatttcccatcttatgtatatgcaagtgtataacaaagcagcaattgatgtgtgtataaatctataacttcaacaattgcaaaatgtaaatgctaagtggtggctgggcgcggtccctcatgcgtgtaatcccagtactttgggaggcggaagcggccggatcacctgaggtcaggagttcaagaccagcctgaccaaaatggagaaacattgtctctactaacaatacaacaacaacaacaacaaaaagatagccaggcatggtagcgcatgcctgtaatcccagctacttggaaggctgagacaggagaattgcttgaatacgggaggcagaggtttcagtgagccgagaccgtgccattgaactccagcctgggcaacaagagtgaaactctgactcaaaaaaaaaaaaaaaaaaaaaaaaaaaggacaggaaggaaatagaaaatgcgaaatggtaagaaaaaacagcataataaacatttgtatggcgttgatggacaatgcatttgaagataatatttgaagaaatcatattacaattaatttctgttcttactcattgcagcttgatgcctctaaaaacttcgtcattggaaccatctctggtgctttaaaagaaaaaaaaaaaatccacacactcacacaggtgcaaggaaatcagaatctcaggtattgagaaccagtcctcatcatgtgtaagctgcccaggtgatttgactcaaagccaagattgaggaacggcgacatggatatctacacagaacctgcctaaatagattctctagaagaagtttataaagaaattccacatgaactgtggaagaggatatgaatttgatgtacagtatgtcctcacttaacatctttgaaagtctcttggaaacttcaccttgaagcaaaattatgtacagtgaaaccacttatttttcatcaacagtataactacacgactttgaacaaccaatgctgttggaggaccttctgtacattgtttccataaagtcagttttcagggaattccaaaacgaagtgaggacttcgtgtatataaaatgatggttgtgattccacctggatgacatggttattgctcagagactaaaagaggccacctaggtatagaagattctgtcatgaggtttctgctaaaccaaggatcccagaatcgtcactcattccagataaaggcataacgaagaaagcaatattcacaaaggaaatgcggaaaggaataaaaaccatcaagccacaaaaagaatgtgactaaggggcaggatttgcagataaagagatttaatgtgattgccctttctcacccacacaagaaaaaggatggaacagatcatgagattcgaatgctctgctgcccagcctccgcagggcactttgtatgtccctgtttctcaggctgcagatgaaaaggttcagcatggggtgaccacagcgtacatcactgatgccaccacaccattcctggggggtggtgacacagctgaagtcaggtacatgccaatgcctgttccataaaaccagcaaacaactgctagatgacagccacaggtggagaaggctttatacttcccatctgacgatgaaatccttagaatggaggggacaattttatagtaagacaaaaagatccctgaaatgggaagaaaaccaaacatagtactatcgaaatatatgaatatgttattgatgacactgtcagaacaggcaagtttgagaagttgagaggggtcacagaccaaattagagatttccacattcttgatgatggttaattgtaacacaatccaactgtgcagctgggaatccaacaggctaaggaaaaaggacaccaaaacgaagaagacacagaggtgaggattcacgatgactgggtagtgcagagggcgacagatggctacaaagcagtcataggccatcacagtcaggagcatgccttctatacatgcaacaaggagcaggaaagacatctgtgtcaggcagcccgcatgagagatgactctgctatgcgactgcgtgtccacaatcatcttgggaaccatggccgaggtgaaaccgatgtcaggccagcacaggttggagaggaagaagtacatgggggtgtggagggggcagtcagagctgacagccaggatgctgaacaggttcctcagcaccgtgaccagatacatggacagggacagggacagcaaagcgagggccggctgcagttctggatcctctgagagtcccaggaggaggaattctcagacacctgtgagatattagtcccaacatcccagagggtgtacactacccctgtgatattgtccctaacttccagaggggagaggatgacatcactcccaatatctcagaagttgtacatcccccgtgatattgttcgtcatatccagggaggcgcaggatgacattccattgaatttcgcgacaggcctacacgcacagtgtgatactgttcctactatccaagaagggagaggatgatattactcacaataaagcagtgggtgtacatcacctctgtgttgttgtctctaatatccggggccgggggaggaggggagaggataacattgcctccaatttagcaggtggtttgacgccccttgtgctgttgttttaaatatccagcggggaagacagtagtactatttttgatagtccgattcatcctctccacctttccggaactctgaggccgggaggcggcatgtagtttccgtgcgatccccaatacctttgccgttttctgtaccaaggcagccaaaaacgcaggcccgttgtctgagccgatccataagggcggtcgaaatctaggaatcacatctcgaagaagcacagggattacttcaccagctttctcagttcgtgttggataggcctccacccacccagagtaggtacgcccaagaaccagtacatgcttgttacctccacactttggcatctccgtgaaggtgaagtccacctggagaccttcaaagggggctgctccacaagctcgtatgccgggcggaacggctggaccttgactcccatcttgctgtcagcaggtaacacaccgctgcctcaccgttttggcaagggttgacaaaggcgagatgtagaaataccggcctaacaacttttccagtgactcctgacctcgatgggtgttttcttgcacagccagtacaactgcagctcctagcagctgtggcacagctactctcctatctggtaactgaatccatccttcctccatcacttgtccttccctctacctggagaaagtcctttcttctttagaagaagcaggtccaagatcaggtgcttgagggagcactgatgcccagaagggggcagttgctgcttttcgagcctctgactcagcgcgggaattccccaaacacagcaaggtggaagctcgctggtgtcctctgcaatgcctaactgccaccttgtggggtttccatactgcttctaatcattgcaagatttcttgtggatattttctgtctttccccccagaattcaataggcccttttctttctatcacactccatgcacttgaagggttaaaaagacatactgagaatcagtgtaagtgttgacagtctcaccctcactgagttctaaggcccaaatgaaagcattaagttcagctttctgggctgaagtggcctggggcaacgacctggtttcaacaacagtgtccagagttatcactgcataccctgcacctctctctccttgggggttgaagaagctgctcccatccacgtgtggctcccagtctactgatgcccaagtctggtcccggagctcaggtctgctagagtcaattgagtccaacacttctacacaatcaggctcgacagggctccctgataccggcagcaaggtggcggggtgtagggtgttacaaacttcaatggttatacggggattttcacagaccaaagtttggtacttggtgagcctggcattcgttagccaatgacgtcctttagtattcatcaccacagcacgggaggcctttatgttcaggtttcgcccaagagtcagcttatttgcttcttgtactagcagggcagttgctgccaaggccctccaacaggggggccatcctttagaaactccgtctagtggtttacagaggtaggccaccagcctcagccagggccccacagtttgggttcaaagtccagctgccatcctttctctctctgatgcatacaatggaaaaggctttgtcagatcgggtagcctcagggctggtgctgccagaagtttttcctttaactcatgaaatacttgctgttgttgggatcctcattccaaagattccccgtccccgtcccccttgtgacctcatacaaaaacttggctaatactgcaaagtttgggatccacagtctacaaaaccccacagctcctaagaattctcctacctgccttctgctcttaggctccgctagatggcaaatgacctgctttctttctgatctcgggctgcgttccgacccctgtcggatagtaaatcccaagtaacgtacctgctgtcggcagatctgagctttcttcttggacaccttctacccacagtcctccaggtgcggtgtagggcatctgttcccttggcacacccgactgccgtggggtgtcccagcagaaggtcatcaacctactggagcaacaagcagcctaggtctctgctaggaaacttctggaggtctcgatcccatgcctccccgaagatggtgggggagttcttgaacctttggggaagcccggtccaagtgtactaagtagtgacacctgactccggatcttcccactgaaaggcaaacagcttctgcctctcaggggctaatctgataggaaggaaagcgtcttttaggtccaagcaggtgaaccagctgtcctcagctggcggcaaccccaacaatgtggacgggttaggtactgttggatgtaaagtcagtgtggcttgatgaagcaagcgcaaatcctgtaccggccggtagtccttggtccgtggcttgggaacaggcaggaggggagtgttccatggagactgacaaggaacaatcattccaaacgttcttaggtgcttgagatggacctggataccttgaagggcttctctggggaccgagtcctgtttttgcctcaccggctgggccccagtcttaactggccaatcctggagggttctcttctgcccgaactcttggccagcgcttagccagagctggtcttttctctttgcccgggtcagttcagaaaagtctccattcctcctctcgggggaccataagcgtcataatgactcccattccgggtaactttagcagcaaagagccgtgctctgtgaaagaggcagtggctctcagcttgctgagcaagtcccttcctgaaaagttcaagagactgtcaggcatgtaacaaaactgatgaatgactttatgtcctcctacaggacaagtccaaggcaagcagaaagcttgctttgctgaaacccccgtggctccgatgacgtcagtagtctttttcggtaaggggacaaccggggcggttactagcgaatgttcagcaccgctatctacaagaaagttaatgtctccacccctgactgtcattctgaacagatgtcagaatggggatgcttgagcccggtctccctcagtccaagaacccttccgccaggttgagcagggccccttcctccttgtccggggcctccggctctgagtcaccttcttttcttttgagctgagggcatttgttcttccactgtcctatttctttacaatcagcacactggttacgctgcaaactctgacagccaagctgagtttctttcccagggccccctttcccttgcctctttgcgggggcccctctgattgctgcagctgacaaacaggtcggcgtgtggccgggcctgacctccattctctttgccgttttccttacggcttactgcatacctgtttacaaacacctggctagctatttctagtaattgggatggattcttccctgcaagcccagtctgtttctgcagttttcttctcatgtcttctgcactttgatggactaaagccatgtgaatcatgcgctgattttcagggctatcgggatcaaagggagtatacatatgataggcctcatacagtctctcgtagaattgtgctggactttcttcttttccctgaatgacctcagagagcttgttaacgtttgtggccttctgagctcccctcattaatccttccaagagagcttccctgtctcggtttagcctttgcatctcctctctttcatgtgggtccaactgggggtcggttcctggcaactgggtccttccatactgttcggggttttgataatcagctggtgcatgttcctctagccacttagttgctgcttggaggactctctgcctttcttcactgttaaagaggaaaatgagcaactggtgccaatcggtccaggtgtggttgtgggtctggataacagtttggagcaaatcaattagggcttgtggcttttcggtatagggcgatgtattgtttttccagttgagaaggtcgacgcaggtgaagggctggtacccaaaaacacgtctctccactacatgagcattttcatctatcccagtataccgctgctctctcaggggcatttgtgtccccgttttgggtcgtaaacgagctgccgaggaaggggtggaatggcgcaatgcgacttaccgcaattaataatctcaattattaactgacactaataattatcaatattaataacccataatataattttaaaaatcaatacggatactaatgataattaatattaaatagttatactaacaataacaatacatgattaatattgatgattatgacgcctgatattaataactgatactgatcttattctttagaaaatagtaatattagctcctaataattaatattaatattaataatctgagaactttttattagcaattacttcttaatattaatattaatatcggccattcatattcatgttaataaaaaacaaggaataattcatactaatagtatgccctaatacctcagtgggtgtacacccacctgtgatattgttcctaatgttcagggagggagagagcatgatattacgttcaatatcgcagcaggtgcacacccagccggtgatattgatccgaatataatctccagggggtggagtatgacattactcccaatatagcactgggtgtgcatccacccggtgattttgttcctaatattcatggaagaagagaatgctattactcccaacatcgtaggaagtgtacacccccgtgtgacgtggttcttaataatattccaaggcggagggggtgatatgactacacatatggcagaaagtggacacccccaaggatattgttcccacgatcctggagggaagaggatgatattgctttcagtatcacagaagttggacacgcccccactgatattgtttgtaattgcaacgtgggagaggaggatatgacacgcgatatccgagggagtagaaacacccctgtgatactgttcttaatattcagagagggagaggatgatatgactcccaatacagacggttgtacaacctctgtacgccggggtgaacactggtgggtgaaacagttcacaatctccagagcgggagacgatattactcacaatatgataaacaggctgtgagtccaccgcggatcctaaaaaccaggggggcaagaggggttagctcttactctgcgcatggcggggcgtgcctcaccccctgcgatgggggtcctaagagccaggaggtaagatgggaaggctcttaatacccgcatcaaggggcgtgcctcacaccactgcgatgggggtcctgagagccaggggggcaagaggggctggctcttaccccaagcatagcaggacgtgactcaccccgctgcgatgggggaaactaagagccaggggggcaagagggtttggctcttacaacccgaaacggggggagtgcctcacaacctgcgatgcgggtcctaagagccagggaggcaaggggggatgcgggagacagtggctgtcctccatctaaattgcaagaggctttcctctttgactactccacctcggcacagaccctttacgggtctcaggctgggggacagtcaggtattccccatcccacagggccatatttcagactgttacatggggagaaaccttggacaataacctgctttcaagggtagaggtcgctgcggctttccacggtgcatagtgcccctggtttattgaaactagagaatggcaatgacttttaccaagtatactgcttgtaaacatttggttaacaaagcacatcctgcacagccctagatcccctaaacctcgattttatacaacacaggttttctgagctccaagttgggtcaaaggggctggggcaaagtggatgaggcaaggcaacaaatgaacaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacaggggtacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaacttcaggttagtttcgctgaacaattgtttctttcacgcaatccctgaggggtgttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgtgctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgccacagcgggaaaagcgatggaatccaaatcacagtccttagttggggagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcttggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacaacagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacattgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtatttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaatggaaaaaggactttggaaaaaaggggggtttgaccttcagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctgacaggggctccgtcttggcttcactgtctcccctcagaaaagccagcctgagctcctcctcaagtcttggaccaaaggaaagacagacaggggctgcggccgacatccctcagcctgcagtcaggcaccagggccgcgagcctctcctcgtggtgaagccgacacacagcagccctgagggtggctgccgagaagttccccaggctgcctccaaaacccacggcctgctccaggccgccagaccccaggcacaagacaaacgtcctgcggtgacctcacagccctgcccgccagccgccacacacagcttgggcctcggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaacggcagcctccgcacagcagaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataacctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgtaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagatgtgtaatttcaggttggtttcgctgaacaattgtttgtttcacgcaatccctgggggggttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaatggaaaaaggactttggaaaaaaggggggtttgaccttcagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagtaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgccacagcgggaaaagcgatggaatccaaatcacagtccttagttggggagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagcagccctgagggtggctgccgagaagttccccaggctgcctccaaaacccacggcctgctccaggccgccagaccccaggcacaagacaaacgtcctgcggtgacctcacagccctgcccgccagccgccacacacagcttgggcctcggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaacggcagcctccgcacagcagaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctgtctagatgactgaataagggaaaagttagggaaccctgagaggtgcagcccttccgctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcagggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaggaagacaggggtacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcggaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatacccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtgtgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccggggtgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcttggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggaggcaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcctgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccaccaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctgacaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtggggctgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggaggcaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagccgggctgctgcagcacctgcccatctcagcgccagcctgggaaagaaagtagacgtgtaacttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccatcccaatgttaacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagcctggggttgaagccaacccggggcccttgaacaaggataagggagagaaggaagagagaccaaggtgagcagtgggaggggttttcaccactcttagggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcatgcaggttccccacgacagggggaaaagcaatggaatccaaatcacagtccttagttgggaagcctagagggccacctggaggatgggaaggttggcacgtgagggaaggtgcagaggcggaaagggcaccagatttccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaatcttctgattatctgagggtgagtgtcaccccgggcccctggtccttttatcctctaggtaaccctggttgatttcctttcagcttcccgtctgcgggaggaaatcggggaacccctctttcttgtcttcttggggtcagggcctccacgatccttgcaggtcagtttgattccaggcgaagtcatctgaagatgccgtatttcctgtggctttctttctgtccaattatggcaagcctgccaacaacacgttcctagcggcatgaggaaattagtccctcagaggccgcaaacgtggagaaggctaaacccaggaacatgcatgtgttcatagaagacgtcccgagtacccttgagccaccaacctgccttcggaaagccattagtccgttccacttcatggaaggctgagtggaggcactttgatccagttaatgcccaagacgcaatcttttgaacaatggtgtgcttagatcagctacacatagctcgatagcgcatcgttcatgtgtcttttcctgatcagcactcaggtggagggtctgtccctacttccaaggaccgcctgtcgatactgtactaagaatttcatggtgtgtgcaccttgtctttggatgtgtttgattttcatgttggctccatgctgaggaacttctaacctgtgttgtttcctctctttcaggttgcaagggggccaatgccggtccacacaacctgtaagaggccgcgcatggaccctgtcctctctggtcgctcagctaccgaaatgtctggcaggggctccgtcttggcttcactgtctcccctcagaaaagccagtctgagctcctcctcaagtcttggaccaaaggaaagacagacaggggctgccgccgacatccctcggcctgcagtcaggcaccaggtccacgagactctcctcgtggtggagccgacacacagcagccctgagggtagctgccgagaagttccccaggctgcctccaaaacccacggcctgctccaggccgtcagaacccaggcacaagacaaacgtcctgcggtgacctcacagccctgcccatcagccgccacacacagcttgggcctaggctccaatctcagctttgggtcaggagccaagagacctgcccaggctccgattcaggcttgcctgaacttccccaagaaaccgagactgggtcccttccagatccccgaaagcaccatccagggaggtgagctgggggccccggagaatctccaacctccaccagccgcaaccgaacttggaccaagtaggtcgccccagatgggcaggaggacaccggcccaggtgcccagcgttgaacggcagcctccgcaccgcagaccttgcctgcctactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgcgctgacttcgatgctccccggctgtcgcgcttctgtggatgtgggagcccaggccaggcagagaacagatgcagggactctgcctcattgaattctggtgagggacattgtatttcgcatgggtctccagaaacgcaccaggaaaagcttccgcgtcagtgattctttgcgtcagaaactgcgtgatgcgctggagtcagacttccgctgggacgtcaataggaaactagggaattactgtgtatttgctctttagatgactgaataagggaaaagttagggaaccctgagaggtgcagcccttcctctgtgctccgccttgagagcagtgtttcggacgctgggaagcgtgctgtgcaaagtgctctcggggtctttcctcagcctcgaaaactgggctctggaatgcctttgtaaatatgtgtgttgaatttgttttgaagtgaataaaattctcaaaaagatgacatattgtcttttgactctcattccgtgtttgtgtttaactgattttccaagtgtagggatcgcctgcccctccacacctgtgggtgtttctagtcgggtgggatgagagacggagaaaagaaataagacacagaggcaaagtatagggagacaaaagtgggtccaggggaccggcactcagcacaccaaggacctgcaccggcaccggcctctgagttccctcatttttaattgattatgattttcattatttcagcaaaaaggaatgtagtaggagagcagggtgataataaagagaaggtcaaccaaaaaaacatgtgagcaaagcaatctatatcataattaagttcaagggaaggtactatgcctggacgtgcacgtaggccagatttatgtttctctccacccaaacatctcagcggagtaaagaataacagggcagcattactgccaacatgtctcgcctcgcgccacagggcagcttttctcctagctcagagttgaacaaatgtacgatcggattttacaccgagacattcagctcccaggggcgagcaggagacagtggccttcctccatctcaactacaagaggctttcctctttgactaatccacctcagcacagacgctttaccggtgtcaggctaggggacagtcaggtcttttttatcccacaaggccatatttcagagtatcgcatcgggagaaaccttggacaatgccctactttcaagggcagacgtccctgcagctttccacggtgcattgtgcccctggtttattgagactagagaatggccacgacttttaccaagtatacggcttgtaaacatttggttaacaaggcacgtcctgcacagccctagatcccttaagccttgattttatacaacacaggtttttgtgagctccaagttgggtcaaagcggctggggcaaagtgcctggggcaaagctacaaatgaacaacatctcagcaaagcaattgtttaaagtacaggtcttttccaaaatggagtctcttatgtcttccctttcgacatagacacagtgacagtctgatctctctttcttttccctacatccaagggcttgaacatttcttgacttgttagcaatccaaatcgttatgtctccgaaacagagttgactgaggggaccgcacggctgggcaggacctttgacttcgtatacatccacaggagaaagagaacctcagccccactctaccaacacgcacctagtaaaattccgccaactgaatctcacgcacgctaacacgtggggagcgttgcttgcaccgcgagtccccatttggctcaaccgcctatgccaagtgtgtggttccggttgcgacggccccccgtgaagtggcttccggatgtgcgaatgaaccaggcagagtttcactgaccaaatagtccccagcaaagctgtagttaactcccagatttgggatgtacttcagaggtaaaacattcatcccatcttctttccggatgtctgacaccgggcctttccatggttctcccactgatcctaagagtagctgaggtagagactcactgaaagatctaggcagggatatctcatcatgcacagactctctctattctctgacctgggaacaactctgagcaggattccacatctaggaggcctcggaactgagcggtattttctgagacacactgaatggctgctccctttccgccgctgttgagggtcgttatcttgattatccagatcacctagaaagtatccgtatccagaatcaataagatctactctctgctcctctgacagcagaagcagcaggaccacaatgaaccaaagagcgtggaaggaaacgatgtgaccggaaagctcagagaacggccacagggagtcgtaagcaggccttccaaactgaatcatgaataattaatgaagcgcaaatcaaaggggactcgagtttcagcaggtgcaattcatccaaagggagatcgccggagggccaacaagattgagaaactgggagtcgggtgcagtgtcaagggggacgcgactggttccaaagctcgagaagaccatggggtcacttgggctacatgagaaaatgccccagtgtgctggttcatcattccgactcctgcctgtctcttcccgtccaaggaacatggaccctaactcgtgcagttccagatgactatgggcagaattaggggccgtggcccaaaagttcaccgacatgggggttccacagaaggtgaggtggatctttgcaaatccagagaaatgacaataggacccagggaattagagcctcacaggcgtccgggagacttttcaggtataatgtctggtgtcgcaagacgagctgaaaagggagccaggcactgaaagacaaagcggtgttgactttcttcatctgtgtttcccaaagcagtccaattcactttggtagaattcatgtatttattttccgttggcttgtagttgcaaacttttgatgttattgatttttggttggagagtttcggtttgaaaaagtagatattctgaatatggaggttgtccaagattgtatctcaaggtgagtctacttgattccagcgaaccatactttgacatataatacatatgttttaattatattttgtctgttttaaaacagcttaaaaaatcacttcgtggaaaatgtcacttagatacaccaatgttaactttctcatcacatgtccagaggcactgtaaaattcattctagaatgcaaaattcccagccacttctacgtggaactttctgcagaatgggattgtatccagttttcagggggcgcaggtgtggtacgagctggtccttggtttcctgctgaagttggaatcctgcagattgcttaggggcggtttccacctgtcccttctttccaggtcatcactaacctttcctgatcccccatggggactcagaacttatctagagtcacaggcccacctgggatgctgcccttgagcctctgtgctgtccatgatggttccatgccactgatctgctgggacacattctgcagagggatgggcttgcatgagctgtccctgcctttctgaaaatcacagagatttctggtgtctgaagccacatagaaatatctgtggagtctcgggaaggccagggatgccattcacaggctgctgttcttcctcttaatggcagcaagagtgatttctgagtttcctaattgacttcgaaataattttgttgattttgttgtgacaaagaccactcctctttctgtggcatccagttcacctgtagggttttttgggattatgtggaaactcttgcatttttccagagcctcaattcatcctggatgttctcaggaatgcactagctgatccctgccttggtggcatcttgaaacattgagggaggccccttaggtccatgaggcacaaggaggtccatcaggaattgagggggcatgtgtctgcccatctgtagctggaacttccatttgccttcagaatgcaggttcttcctgaactaataaattatcttcatcttggtgtaagtagccacaatataataattcatagtaactctattaataaaaataactgaatatcaacaatgaaggtaataatgacaatgttaattattataatattaatagtaaaaataaaacaaaggcaatatagattacggattcccctaagtgaaggacaatgtccagatatagggacacatgtgtcgtttgcactcagagtcaaatgaaacgtgttcctcaaaggcaaaggacaagcagcataaggaaaacacaacgttcatggatgatcacatgggctaccttggaactcatgtggaaagactgcaggcaaagtgtatctggtactgggactgctcaccagccagcccccacccaccttcatgaggtaggacagcaggataatggggaaggggtccatgcaagggatgcaaggctcgtgtcacacctgattcaaagaagcactgcttctgacagatgtttatctcctaacactgtgtcacctctaactgcctggctgcatgtctgccatctgttcttcttaggtcacaggagggacagacattactgtccacctatctgcatacagagccattggaggctattacccttgttgcttcctctttggaaaggggcaacatacatgccagatgccattctctgtctctttggaaaactttgtcagcacatttaaggttttcttcagccacagaaagccacctgcttcaaagtctcatcctccacaagtggcaagcacacaatcattaatggaggcaaggggtacataggctttgccatttgattcagttgggacaataggggaggacttcttagctctacagctctgtccgtgtggccagctgacaatgtcaggctgcactgcgattagacttgtccctttgcacataaggcttccctccaatcctttccacagatgtggatcctcacatcacttcctaatatacatcctgcacactaaacttcatctatatccagttccctgggaaccaaacctgtgacaaaagtgaaaagtttctagggaaaatagggtttcctcatcagacaggaatcaaatgctgctgagctagaaaataaagtaaagtctgatgccatctcctgatttttttaattaggacattagcactgccagcaagaattatgtgcatcaatttgtggggacaaacatcatgttggagtgggatgaggttgctgtgagttgaggagaaatgctggtgaatggactttaccctcaacttggattcaggagaggacataaaaacagctggaaataaaaggtgtccgaaaacatttttctggtttttcaaaacttccaatttcaggttgggagacactatgtttaaattctaaagggatgtagcatgctgagaagaaataactataaacaaggtgtccattttatgaataatacaatttatggtatgacagaagaccaagggacataacacaaatttggagttaaagaaattaacagacattctcaataattcctcagctattatggcagagatgctgggacaatggatgtccatgtagcagtacttttttttttttttttttttttttgggagacggagtctcactctgtaaccaggctgccctgcaatggcgcaatcttggctcaccgcaacctctgcctcccgggttcaagcaatcctcctgcctcagcctcccgagtagctgggactacaggcacacactaccacactcagctaatttttgtatttttagtacagatgggttttcaccatgttggctaggatggtctcagtttcctgatctcgtgatctgcctgctttggcctcccaaagggttgggattacaggtgtgagccaccatggttggcccttgtagcagtacttttgaacttaatggctgaaagtatccacctccaaacttacatattatatctgcaaaagagtacaaaccatgtgatgaatttcaaagggaagacaagcctgtgggaattcaacagccatggcaatgctttgaacttctttttcttaaacatgtaagaagtaagtgaagttcaagacctaacagaattgccaggaattatttgaggaattaccaagatgaccatagacactatgaaatccttacgatgccctctgctggagtttcctcctacagccagcgattttaagccagaagaaaatgtctctgcaggcataagagttcaacccaaatgtactattcaattttaaatgtgatgacaataaaattatgtgctatatagcaacaactttttttttctttcagacagagtctttctctgttgcctaggctggaatgcagtggggcactcttggctcactgcaatctctgcctcctgtgttcaagtgattttcccacctttttcacaatgtatccttatcctcaaactcatcctcctaagtagctgggattataggcatgtgccaccatgtctggctgatttttgtatcagcaaaattatttctggggtggagagttaggaatcttttttctcccacacccaaaaacatgttgtccaaatgatctgtcaatagaaataattgatacctatatttgctaacctacctttttctttctttaaattcagaactagagtatagaaaaggatattaagaaggttctcttaattttcaacacaagttatgggctaggcactgtgctaggtgctacagatacgcactaatatacccacaatagttttgccttattgccttctatgttctaataatacaccaaaagaaaagtatagattagctttttatttttttgagatggaggttaattctctcacccaggatggaatgcagaggtgggatcttggctcactgcactttctgcctcctgggttcaagtgattctcctgcctcagcctcctgagtagctgggattacaggcacgtgccacgatacccagaaaatttttgtatttttcagaaagacagctttcatcatgttggccaggcaggtctcaaacccctggcctcaagtgatccacccatcttggccttccaaactgctgggattacaggcatgagccataatgcccagccacagagaatagctttaaatagaatgtatgaaaccaaaagaaacgtatgctcatcaattttatactgtatttggccaggtgcagaatatcgacttgtagtaatgtaagggaataaggtcaattcacatctaattgtttggacaagtcaccagaaatcaaaagttggaggagttgtatcttttgaggtgggttgcacaggcaagcagcaagttgctatctctccaaagtcctaaactgttctatttgtcctactgtggaaaaatgagtcttcaacttgatttcaatttatataggaaaatgcttaataaaactaataagggctacattccaggacacagccagaccacacatatactgaaacttgattctagagacacctcctcttcaatgtaattggattttcaagacaacaaaaatataactctgacacaatattggagagccaaaaggaaaggacaatttgggttgaaattttttcttttaaaaatgtgtccttgagttctattaacaatagctaaagcctaggaacagctcaaatgtctattgagaggaaattgataaattatatgcatattatagagtaatatttagcaataaaggggaaaaatcaactctatgaatcaacatcatgatcatggatcaatataatctttctaaccccgattggggaaagctaagctaaaaagtgtcctataatataaataaatgtatacaaaattctagaacagacaaacctaatataagctaaaaaagttcaggaaagtcaggtgcagtggctcatgcctgttatgtcagcactttgtgaggtgggtggatcgcatgaacccaggagttcaagaccagcctggccaacatgttgaagctaccccatctttaccaaaaatacaaaagttagcccagtatggtgtggtacacaggaacagaaaaccaaatactacatattctcatgtataagtgagagctaaacattgggttatacactgtttagctctcacttatatggaaacaacagacactggagattcttagagagaggagggagggttgggtgcaaggcctgaaaaactaactattgggtattatgttcactaagtgtgtgatgagatcattcatactgtaaacctcagcagcacacaatacatccatgtaacaaacctgcacatgtatcctctgtgtctaaaataaaaattgaaaaagtaaaaaatgaacaaagatatatgagcaggcatttctcgaaaaaggagatacaaatggacaacatatatataaacaattcttaccctctctagtcatcacgggaatgcaaatgaaaactaccaagaaatatcacctcacacctgttagaatagctattatcaaaaagatggatgataacaagtgttggtaaggatgtggagaaaagggaacctttgtatactggtggtgggaatgtaaattagtatggccaccttggaaaacagtatggacgtttctcaaaaaattaacaataaaaataccattttgttccagcaatcccacttattttatatataatatatatatctatatatatacatatatagatatatagatatatatatatgaagtcacgaaatcagtatgtgaaagagttatctgcgctcctatgctcctttcagcactgctcacaatagtcaagatctatgaagaagacatacatgttatcattcattcatggacggctgaattattgttttatatatatatatatatatatatatgtacaatggaatattattcagtattatataataatgaaaccctgtcatttgtgacaacattgatggatctgaaaggcatgaagtcatgtgaaataaaccaaacacagaatgacaaatactgtatgattccccttgtatttgaaatctcaaaaaaacaaactcagaagcagagggtagactgaccaagaactgtggtgcaggtaagtgtgtaggtgtgattacagtacaaagttttagatatatcacataaataagttcaggaggtctaatttatagcatagtgcttatagctatgaatactgcattgcatacttaaaatataataggagggtgaattttatgttaattattcttaccaataaaaataataattagaatgggagggagaactttgggaggtgatgaatatgtttataatcttgatggtagtgatgctttcacaatgtatccttattctcaaactcactgagatatacacattaaataggtacagctttttgaatgtaatcatgtctcaacaaagtgtttttaaggggggttggttaaaaaatttaaaaaggaagggtagatgttcctttgcccttctctcatggatttttctccctgctgtctagagttcaggaataataggtgggaatttagcagccaaactaggaccttttctaaagtatagcagagcagagagccggaagggacctgcatccctaatgatattagaaagtatctgtactagccctgaatggtataactacaggttaattttaagtgaaaaagaaatcaacttctgctttgcttaagcaaacttattcaggcattaattttataaacatgtagagaatatatactccttatgagcagaaacaatgtttgtgccatatggtacatgatgggtgttcaataatgtgtgatgatgataataatgaacacaatagtgatacataaaagaaaataaaaagcagtgaaacaaagtggtttaataaagatacatagttattttgttgaaagattctgctgctaatattattcaatacttttgtatgctggtgcaagtaaggaaatttacattgtctaataaaaattatttatcaatttataaaacagtaaatatttcatagaatggggctatgaatctgcattgcaaactaacactttcagttgattttatgcacagtaattattgagaatccccttatctagatccaacggatctggacctacataggtgctaccaaaacttaaggaagaaaattttcctgactctatccatacctccagttagtaatacatctagagatttagaactgaaatccagacatcctgcttccatgtgcagtgacctttcactgtcctgttttgcttcacttgatgaagaggatttgagaataaatgaccacatgattcaactcctcctcagctctgaggaatatagccctgtcctggcaaacaagaagctcctgcagtagtagagggggcaaatatatgttcactaatctaacatacaaggcagtaggcactgtaccataaacaaggcactgtggggattcagaccaggggcaaagtggggattaatagggcaagtaaagtctgggaagtgttcactaacaaaatgtctaatcattaaactaaacggtttctcaacatggcctaattaattgtaacaatataaatggttgtttgttcataaaccttaatcttttgccaaaatatttgtagcttatgttcccatttaacaaggttttctggtcaaaactgtgcacccacatcattctaatgaacttagtgtccaataaaacatggactctcagtcgtctcatgaaggtcattttgtgtgcatagtacatctctgtgaatatgcctaatgaggtatggaaggacacttattatccaaacaaagacattccactggtgctagagagccacagacggaagttttctctgcctactggaaataaagccaagctttcttctttcctcagccatgaggattgctgtcttcctctttatcattctgtctttttttttttttttatgagccaagctccaccaaataacaggataaactttgtgtaaggcttggtaagagtagagtgtctgacacattatggtgctataatactcaaagcaaaagcaaaatcgcctatgaccagaaaagggagtcacataggaaatctagaagacctattggctgagagacctgcagcctcatagttcattagctctccatagcaactctcacatgaaatgaagtcagtggtgtttcaagtgcttgaaaccctctttactctacttctaaatgtgaattaattaggcaagtttactagcagttactagacctcaaaagcaaaataatcaggcattattctactaaatattggtctccataactcctctattttcttttggaaaagttagttagtctaagacatttggcataaaggctatgccaaagctttggtggggtcagccaggaaggattcgtggggcctccttgaaaatattgcaattatctaagaaattttcaacctattgcccctcagtactgttggtcccctgtacttgacttttccccttaagtttgattccatttcctaacattatccttccctcttcctcctcagcaactagtcttctaaattagaacttaaacacaatgaccagatatgaccctgcaacagagcatgcccttctgcattgagcatgcaatcatgaatcacaggtataagaccccttgaacagacatggttttggtgattctgtgtaggacttattgcttttacccaagaagatgatcaggcatcctaagtagatcagaaaattttctggagctcttgaacttgtataggcaagaaagattaagcaacatgttgccttatatgaggcaaactatcttctcatattttcttttgaattcaggatttcaaggttggggaaggagtgggaaagtagccatggacgtgtaagaatgcggatcgtccttttacattgtcagggatggtcaaattctatgctttatgttgtttgctaaaagacactttccaaagttttcaacagaaaatatgatggcacacatgcctattcttggtgaacccagacttttctatctagtctgtgatagtaaatttaaaaggactgcttagggtaaatgaatccttcaagttataaagatgaagggcagtttttggacaattcccattttgctgtaggaaaactaatctggaagaagtaaaagggaaagattgaaatggagataatggagatggagaatgagttcagttgatcaaatttttgttaagcgcccactgtatgtggggcccttacaaggaaacaagcagacaaagaaaaaaagcatgtgatggccttgctcctaagaagccagaggccagtcacctggattgctacataccaggaagacgtcaacaagcccctacaatacagcacttgcataggatgaagaagaggtttctttgtatgagataaatagcacacaaccaaaaaaaaaaagccaaaagatacacaaggttcgaaaacctaagtcaccaacccttaagagatctgattgttggtggtgactttggaaggaaaattattattaggattattttagtactaagagttttgagctgtctatccaagattgtcatctgcacctctgccttaggtaatactgtgtgtgtgtgtgtgtgtgtgtgcatgtgcgtgcctttgcatgtgtttgaaatatattctgtatcccacactccacataggtttggggctgatctgaaactatactcttagggatggggttaagctactctgtcacattgtgaagagttgatatgtaagagactcttaaccttttataaattacctttaaaatgtttccttttctgtgaagggaagaataacaatttgtaaacaaatgcaaaaatatctttaactaaacaaaagaacagtttgttagccttgttatgattagcagagaggatagctgcagacactgtaaaatcactcagcaacaagatttgacaaaaccttaaatatgggtctatttttcctgttttatagaggaaaatattaaggctctgggaactgaagtgcttttcccaacagtggagtaagtgtcagagtcaaggctgggttttacatcccagctttccctatatattccaccctatggttctgttgtgctgttcctttgtgtgactccgtaaagcctgcttaaaagtgatatcatatcaaattgtattaactcagtagcacataacaccagggaattgatttataagatttttattcttgtggcgttgctgaagacccatctgattagtagttatcaagtagtcatcctggctaaatatatgggtttgatttttaattttgaaaatgaaaaatattttaaaatatatgtcttacatccatatcccaggaaattctaatcaagttttaaaactttcaaatttagataaactaatggttttttgttttaattttctctcaatgaaaatagaagaaactaattggatagaacagcacagcagaagcattacttatagccataaatgggataaaacaagactgaagaagaaaatgcaagacagtgcttaaaaaagcagtctaatgaaaagtgaggtctcctctggatgtccttaggtagacactgcagcagaactgtaaagtttttctggaagtctggggaagagaggaggaaacagagaaggggcaagaggagaaaatagaatgaggctcagaataccaagccttagtgctgtccctatcgccttcctcgctagatcactgggtgatcctgggcaagtttcttcctttccctcagcttatttcctcatctgtaatgtaagtgactagacaagatagcctatgatgttcattgtaactctaacttttccttcccaaagcaaatagctggaaaagacactgtgcttacaatatgcaacaaataaaaacaaaagatttttaaaaacccctagtgtaacttgaattcttacaaataagcaatggtacatcataattttacaaagctcttttgtgatttcatttttaaaatcaagtcaagttttattttacttcataataagataatggagataagtgttaaatgggttcatgaaggaatgtttgtaaaagatgcaataatccaaaataggtaattgttatattagtagttccctttacttgggtggggggggggaacagatagaagagtgttaggaaaagcttcataaagtggattatatagaatgtgctttaaaagagtttggtgttttactgagtggggaaagagcaatatggggagttattgttcaagggttaaagctataaaaaatgaatcaattacagagataggctccaaaccatagtacttatagttaacaataaggtattttgtatttaacaatttgttaagagggtcgatcttaggggttctgacaacaacaacaaccacaacaaagggacgtaggaaacatttggaggtgatggatatattattacctggatattggtgtggtaacaagataatacttatgtgcaaacttgccaaactatatccattaattatgtactttttgtgtataacaattttacttcagttcctactatattgcctggcaaacaatagatgtataaagtgagatcaatgattattgcatatgcatgtcaaaaataataaagaaagcaggtgacaataaagacatcctgaatctttgggaaataaatagcattcacctgctttctcatccattgagatatcaccacctttatgtacttatgtgtccctggaagtttcccgtgggagatttagttattctcttttcgttaggctctactgaccaagaacaaatcacagactcagagagcatcataaaaaggcctagacccacgatgcccagagactccaggctcaacccacattgatgctggcccttcagccatgagactccatttgcttctccttattctccttcttttttcaattctcttatccccaggtaagttggtagctcattactataaggttctgcagatgagaatgctatatccctggccagacaagaacctagaatcagtcctgtgggttcaagaacctaatatttacagcttcactaggattataatagggaaaaatagaaaagagactcatttagcagtatgtcctcttgataagattccatccatgtcttttgacctagtgagtggatataataatggatgctgctgaaattcaatcctgtcagatgaaactgcctacatgtaaatttccatgccccaccaagcacctcaagatacaaagtaaggatacaacagaacatgacctcaatgagatgcctttgcgggacatggaaatttatatgcaggcagttagatctgacaggattgaatttcggtggcatctattattatattcacttaataggtcaaaagagatggatggtatcctatcaataggagctactctaaatgggtgttgacaaatctgaaggttttattcgaagaaacagaaaaactataatcctagaataaatgaaaattatatgagagacttttcaaaataaattatgttttatgtggttatgaataaaaaatgattttcaaagtgcaactgaagagtagaaaggagagttaaaggaacttcagacaagtgaattaataaggagcaaagacaccaacaagtgctgctcaaggtatattacaggtaaccacacagaaatgggtaacataactttcaatacaaaaatggctaaaatttactgggctaagcatgcattttgggggcttttggaaaaaaaaaacagcataataaacctaaagaagataaagggaaaattataaatacaaaatataaattaatgaaacaaatgagaaaaaacagtattttaaaaaatgtttttcaaaaagtctaatacactttataataacctggcaacactgaacaagagaaaatgagaacatgcttaaaataactattgcaggaatgaaaggttaatatcaaaacagatgtttcagagattcaaataatttttaaatttgtgtatattccgtcttcactgtgtacttggggattttcctgttgcagttcactatatcatgactgtgtcatcaattttgatgctagtaaattattaccatcagcatacaaatatgctgttgtttttctgatctaagaaaaagaatttccttgcttttcttctgatgccagctgtcctccccttttttgctctacttttcagcaaaacatcttagaatagttgtccatattctctgtcttcaattcctctcctctcattgtttcttaaatatatcccaatcaagctctcattgtttcttaaatatatcccaatcaggctctctccccctttttcgatcatgctattgacaccacttttgtcaaagttatgaataatctccacattgctagatccaatgatcatttttcactacaactttaatcgacctattagcagcatttgacacaaataatcacttccttcttcacagtatactttcttcatttggcttccaggacggctcattcacttgattctcagcctgtctcactggagctaccacttcggcttcctttgtttcttcctcatcttttgcttcacacctcctacaggagagctccagagctcagttcctggtcctcttctcttctccctcaccacacactctttggaggggctcagcaagtctcatccctttcaattctccttttggacctccttttgaactccaggcttataataaattatccaactgcataactggtatatctacttggacacttgatttcaaaagtaatatatatccaaaaccagactcacgattttccctcagaaacctctacatacacattttttctcttcttgcagagtgccatggtcagcattggagcctctcttagctttcctgtccactttcatcctcagcaagcctctatctctgcacctcaagaatctctcagggctcccatcccttgcccaacctcgggcagtagctgccacacactcagtgaaagaccagagaaactacttctctcagctaccggccctgccctgccttcagacctcatcatgcctctcttcttatgcacctgtgagaacagagagtgaaggggggattctctcagctccccaacccactccccagtaacacagggttttcctcgattctcacagtgagacctttaccttgctctgacctcaaattgcaccagttcctacatgcctgtccctcaaaagtgtctcaggtagttctcctgctctccatctgatcttacctaggagcacacaagataggtcatgaaaaaaccattagtggggccacacgcggtggctcacgcctgtaatcccagcactttgggaggccgaggccggcagatcacgaggtcagtggctaacacggtgaaaccctttctctactaaatacaaaaaattagccgggtgcggtggtacatgcctttagtcccagctactcgggaggctgaggcaggacaatcacttgaaccctggaggcggaggttgcggtgagccgagatcgtgccattgcactctagcctgggcgacagagtgagactccgtcaaaaaaaaaaaaaaaaagaagaagaagaataaagaaagaaagagaaagaaagaaaagaaaagcattaaatcattagtgagtgaatgagagtgagtgtgtttgggcccctactgatgctaaactatcacaagcccacactcagcctttcaacatttgcttgaggttcacttgtttccttcttatctccatcaagggcagcttcctcctgcttctgctgctgcaactcaggtacacacaaagcatgtgtggatccgttcttttttcagtagggcttcattactctgaatttaagttaattagctttttttaaagacttcagctctgtcttttaaaatgaaatctatgatctatagattatccagcttattcttttgtcagggcaagagcatttttctataactttctaaattctaaacaaaagtaaaagttcacttctttccagaatccccccatgtcagaaagtattactattatcatcagtttagtgatatttatggaattccaagttgactctgagatcagcttttgggttaaattctttcttcctgatatatagcctttgaaattttatttgctgcagatctcttggtagtgaacaattttagtttttatctgtcaattttgtattgttatttttgttcttgaaagacaacattactgagtacccaattctatattaacagttatgttctctcaacgtttgttgatactagtttattcatttttagtttgtgcttcactatgatattcagataaatattatttcattataaattgtccttttttcaatgtttgtatggtctggtgtttggttttaatattttataatttaactaatgtgaatttatttttatatcatctgttagaaatatattctttgaatcaatggatttatactttttcttaatttctttttgagaatctcttgaaatggtgaatcctcttacacttctcttcccgcatatttgaattaaataaatgttagaccttgtgtttccatgctacattctgggtatatcatttaagcatttttttctttactaattatcctgttacctatatctaatatatcattaataacttgcattaatttttaaaattttttaatttagaactgcattttggttttgttttgttttgtttttttggagacagagtctcactctgttgccgaggctggaatgcagtgttgcaatcttggctcactacaacctccacctcctgggttcaagtgattctcctgcctcagcctcctgagtagctgggactacaagtgtccaccaccatcttcagctaatatatatatatatatatacatttttttttagtagagacaagttttcaccatcttgggcatgctgttcttgaactcctgacctcgtgatccacccgcctcggcctcccaaagtgctgcaattacaggcatgagccaccatgcccagccagacctgcccattttttctatcatctatatagctttactattgtttttacatctttgtaatagtagattttttctttaaacaatcgatacacagctgcttaattatttctccacattgacaatttcaatacatttagttttcaaggatttaaatgtgctattcatttcattaacttttattcatggtttctttcttacctgatcatttttaatgatgaactcattgctcatccttaatctgccatcattctacagtctgaaataagaatgctattattcaaacttcctctgtgaaactgactcaatcctttatctcaatatagaagttccaggattaacgaactggaatttctgatggcccaagagtcagtagtaccaccattagcattgttgataatagcagatcttcccagaagatatgggaaaccctcacccacctccatcagctagccaatacaaagtgcctagtgctcaagctccagttcacagactgtttttgtgtttgaaagaggagatattttaagaacttgcctaaccattttcaagaatagaaatgtttcaaagagatcgtctaaaatgtatttgttcgatagcagcagtcatttgagagcagctaacttgcagtcatggccaaaagcctaaatctttctttcattctaatcacacctattttatatattttggagatattaaagattcagatgtattcatactattctatgatttgggacactgctatagattcttcaaaatgttacaacattccagtggtattttgggaggtatagaaggtgagaggaaacaatgggctcaagtctcccctgacttctcttcttacaacatatttcattgtccaaaacttttagaactatatcaatacaacattgacagtggatattcttcttttccttctgattttaataggattgaaggaagtgcttgctatgaaattgctatatgggttgtaatcagacaaattttgactttgaaaacgcaatattcttctcattattttaaaatgtttaccaggattcacagtattattttcaattctccccgttcaaaggcatatttaaataacttgatgaaagggcaatattatatatgttactctgctatggaaacagaaaaaaccaccaccaaattgtattctagatactttgtacaccaattgcaccatctttttttatctaagacattcagttcttccacaggtgggagcacatgaattagcatcatttagtacttgtagttttcactacagactttcagacttatggtgcctaaaggaaatagaatgcttctagctgggtttaaaagctacaaataaacagaggaaatatacactattttgaaagtaccacttgagcgttctgtatgtatttcaatattatgttgctaattttaattgttcaaggttaaggagcttaaacctcctcctcatgcattcctgaatcatccattactcgcacacatacattgtttgatacagcataaacctaagtaagtaaagatgtggcaaaatgaaaaaaaaataaaataatgtgataccattcttatctaggaatggcatcagtagacagatgtgaataaaagtaatgtgattataattttaaaaatcatatttaataggatccatttattattaaataaacattaaattacttaatgtataataaacccttaacacgatgacaactcttaatgcagagtgagaccaaaatgaaggtattaactattttcttcctaatccttgctttagttgttctttccaccagactgtcactttattcgaaggatattgtaatagcacaaagccatcagctttaccattagagagatcttcattaaattatctttgttgtaataaaggtcatctggaggaaatactggtctgaatacaataataaatgttaagctttctagtattttccacttttagacacaaattgaaagaatcatttataatgtcaaaaacacttttttctaactaatctattctatgactaagacactattagcaattaaagtagatagatcaaatctaaatatggagagaaaaagtaatttctacttatgtttaaacaggtgaaaccacgaataaattgaaagcctgaaatattagcttaggggaataatgtcactttcggggagcaggagcagcatataccagcctttagctctacacactcccccaaagaaaaaaaatatatagatagttatgtacaaaccaaaatagcactgggagggttcaagggaccatttaagaaactatggcaacacagtgaagccaacaaaaaaaaaaaaaaagagagagagagagagagagtgaaagaaaaaaaaaatagccatatagaaaaaacagctgctgaaatcagcatacctgagatgccagaaacatcttttttggctagaaacaaaagcagaaagggactatctgtatcagccacaaggtggaagcaccagggccctcagtaacccactctggcagaagacactggcattttttgccactggagtaagcaacatccctttctgacagaaaacccagagaaaaagatgaagaggtaccatctcctcccacatcccttttccccaccaaaaatgcagtgactgttgggccaaaccaggattggaactgctacctttcttaaactgcatgtgtctctgacatatgagcagcaaccatgtcaagagctcccacataaaaacgttcatactaaatttattctgttacttaagagtgtttatggatttacattccatttgtggactaactatctcactggatcttctttccttcagtaagaggtggtttgggtcctgcggaaggtcattgtctcaatttgtttggtgtttgcagaacagatgtctgcaacatagtagaagatcaaattggtgcctgccgaagaaggatgaagtgctgtagagcatggtggattttaatgccaattccaacaccacttatcatgtcagattatcaagaaccccttaaacctaacttgaaatgaaactgaaacaaaataaaaatacatcaaaagtgaagttatttgcatctaagaatattaaaatatacatattaagtacttccatcttgataaccgtcttgcattttcacttatcaacataaatgaataaatactaatttcaaatacacccaagtactatttctttgtgaatcattaacatatcttaacaaaacttttaaaaatgagaaaactgttacttttgttttccaagatggtggattgaaggcattgttagtctgcctcttgcacttggaaagagaaattggtgtgtagagactcacactgtgaactttctttcaagaagcaacacaggaatttaacaggaaaattgaaataagccacagaccatttgaaagaaacagcaggatgcagcttacaccataagctaggcagaaaattgtaagtttccagggtgtgacaggagggtaactgactctaagatatacgcttccactgggaaacctatcaatccaggccgtgagggaaggccttaaccctcctcagcgctggagctgatttagggaagagtggtgagtatatgaggagtggcattgggatgtgctttgaatctccagcacattcccagtttctggtagaatggagggaagccattgctgattctacctcagacaggacctcctagaagtctgccaggtaactcagatggttgtcacaggttgagacaacctcccaaatgaaatgtgtgatataatcttgactggggacaaactccccaggccagaactgagaggtgagtgggaagtgtgctgcagcagcaagcacaggagctgggggcccctgctctgcaggtggatcaggaagggtgtggcctgaaggttgcagttgctgtctccataggggagacttatggtatgggtcagttttgagttctgagcccagacttcttgaagcttagctagctactcccattggaacactgtgggtgtgagacctgccttgccaagtgtgtgggagctggatggggcttactaccaagctgctactccccattcttcacatagactctccttgtacagaggcagtgacagtttcacttctctctggaaaattactccagtggcccaagaacagccttccaattcccactggagccactgcttgtcccacacatagacagccagagcatcaccttacctgacctagttcccacctggctttgctcaaccacctaccctggtagattaacacaaataactgaagaaacttttagaagctctttggctccacttatttcctgagacaccagagtgcctccaatgggtaacataaggcaagtccaaatctcaccactaccaccacagctggcagtcttttggaagcaccacctcctggctgaaggcctactgacagtcctttacagcatctgcaggtagaataacatagcacccaggaaggagaaaagttgtgagtgaccacaacttttaccattgcttgcatcattctggctaagcaggaggccctgagtctgtccatgtgatgagttcattactactacaactggcatttgagaaatccaatacacaacacactaggactatttataaccaaggaatctttcagagtctacaacactcccctgccatccccatctgatcagctgctgatacacactgctgtgagacgtgaggacaaattatatcactggatccattgcagacattcttgagcaccagcctggtgtgcggcatccccactgggtagctagacccagagaagcagcagcagcatatgcagtaatctgaatttcatggcctcctactctgaggaaagaggaagcacaccacatcaagggagcaccctggggacaaaataatctagatggccttgagtcccagaacattccacttgtgggaagttgtttggtggtttgtttgtttttgtttttatttccagcagaggaacatgtgcatgctaggctcagcgaggaaagtctgtagctatatctcaacaatcaggcagccttgatgctcaagaagagtcttggagaatggggacttattttccatctcatacactactgcagacacaatagtactgtactcagagccagtgtactgaggtgagtggccataaaacctactgagacaccagccaggagagctaaaggagtacttgcattaccactcccccaaccccaggcagcacagcttgcagctccaaaaaagaccgcttccttctgctagaggagattagaggaaagagtaaaaaggactttgtcttgcatcttggatatcagttgagccacagtaggatagggccctggtcagggtcatgaggtccccactgtggatgtaactaactttttttttttaattttataggctgataggcagaagggacttgtctcaaataagactttggacttggagttttgagttatgctggaaacagttaagactttgggggactgttgggaaagcatgattggttttgaaatatatataaaatacatgagatttgggaggtgccaggagcagaataatatggtttggctctgtgtccccacccaaacctcatctcaaattattatccccacacatcgacagagggacttgtaatcgccatgtgtcaaagaagtttacttcatgctatactcatgatagtgagtgaattcttaggagatctgatggttttaaaagtaggaggttttttttttctgtgcactcacttctctctcctgccaccttgtgaaaaaaggtgcctgcttctgtcttgccttccaccatgactgtaagtttcctgaggcctccccagcgatgcagaactgtgaattaattaaacaccttccctttgtaaattacccagtgtggggtagtgtctttacaacagtgtaaaaatggactaatacaggttccctgaaatattctgagtccctttggaggcaagaatctctttataccagcatggtatactgatgaagtacatcctgatctcatgggctaagaaagaatttatacataccctttatgtgtcagcaactctatgtgcaggcttttgagacccagaatgggctttcttgccccatctagtctatgtaacatttttctaagccaactcaatgtctttcatccacactgggataggtcctaaattgctgtctgttgcccacctgagataatgacatgttgttaaatcaggtgtgtgtgaccctgatacgtctatctgagtggcaggagagggtctatctgttcacaagagtctctgcaacattttctaagtcagttcagaagcttattgattcacctttgcaggcaatgtagccatgagaaaggtctccaaaaattcctgaccttctggaaatttttaaagtctccgcaggtttccagaggtgactgtagctgcactgaaagtcactgcctggataactggcctgttaaagcaaaggcaaaatatgtcaagcccactaagaatacccagaagccatggtattcaattaatttttgtctttcttgcaggtgggagaatactgaggattatgccctcctatagccagtgaaggttactccagtgcctagatgtaccagtcaagagaggtcatgggagagcagatggcagaaagggcagccaggtcctttcgctggggtttactgcttgtcatgagctctgctgctgggcagcatgtgtgatttctgactcctgccatgtcctcaagaagccttgccccatcagccagctgtcctacctcctgaaagctggtgcatgtttgttaacatggagatccagaacaagagtcactttagtatttatccatagagtccccatgtgtgcacatgcttacctgcaggttgtttttcctatttttctgaatgttaatccttgccttctggaactcgatattaccccctgtggccaaatatgggataattgtaaggggaaactgctctttaggtcccaagtccacagggttagtactattatcaatattaaaattattaattatggatattagtatcataataatcatcatcattcctgttaatactcatcaatatgtttattattattatcattaagatggtttattaatgttattattcagtaataaatgtttagtttctccattcactcagtcaaactggagtctgactcccgatatgactatggatatgactgcatatgactatgagtgttaccctgcagatatagacatgaaccgctgtcccagagacagctcttgcaggcactaattgctctttcataggatgagttccttacaggagagaagggctgatctccatgatgtggtttcctcagggtctcattaagggctggtgatacaggagcactgcctacccctcttactcacgtgagagtggtacattctctgttgtcatggctgggatggctccatgttgaacatataaattccaggttctagaagcaaaaaagcaaaagatgcattggatctgcatagggaactgcaagccatccagcaaccacaggacacagtcagaaacaaccacgtggaccacatcgcccaagctcagctgcatggctctccattgggttaggacgaggacctattccaccaggctcaactggagtcctatccctggtcccaggaccacaaggagcatctctttttttggaatcacactgctccattcgaaggacagccctcagttctctatcttcaaaagaggctgcaaatggtgctgattgggagggagccaccagcagcatcaccctctacaactataaaataaaactgtctcccagggtgggatattatgctgaccctacctaaaagcacatttcctagatgttgcttgttgcctggagtttgaacagcattgtccaaactttgccattgaagaacaaggaaacttacctggggtagttgcaggagtaggcctaaatccaggtgtgaagatccttgaactgggggtgtttctgtacctgtagagattgcagactgggaaaggtaaggctctggtcctgccaggctctctagaggttaagaatgtgatctgcagaaagacatgaactagcacaggctactgtagaacatctgcccccaagaatcataaatgccttttcactcatcctgcagaatgcactctctactttaatgatcgtgtgggatgtgactttaatttttaggcatggggattgatcttaagaaaaagcaggcaaagtgccttacctgtcctgggactctgctccacttgccaacatttgagtggattcatttgtgtggtagtcaagctacaggaaataaagggaccagtcagtcttccacacaatgacacagaggccaattatcacaagtccaaatctccatttgtcatccagctcacattcccgctgtggcacaaggtcacatgcactcgtgtccaactccaaatagtagcttcacgtagtatgccagcactctcccacccatcacctcttctagaaggtcttccgctggattggaaatggcctgggataaaagataatgaccacaggaagcagttgtttttttaggatctgatccacatgagaaggtaggacatctaatttggtctgaggactttagctatgctaatatttcaggtaactgtcccctgtgtctatagatttacaatgggaatggagtgagagatgatgaaaactgttttctttcctagtgagtatgaggtagaacccttacatcatgctctctgttacctgttctccatacagagccatctcccatttagagagaagacatggattgtcagtgggagcaagcctgagatatgcccactggcagctcccagaaacccctgaaacctggccacatcatgaagtttcaactgtgggtctcatgcctctcttggtatcttgaattcagaacatttaatgtcatggcaggccagggaacttcctctgctctagtttggctctctatcgcacattcaccgcccccccaccccccgccacacacacacaaagtcacacacactcacacatcaacctactggcaaaccaaggtagaaacacacacacacacacacacctgctcaatccaggccaatatccctgatgaacattaatgcaaaaattcttaataaaatactagcaaacagaatccagcagcacatcaaaaagcttatccaccacaatcaagtcggctgcatctttgggatgaaatgctggttcaacatacacaaatgaataaatgtaattgatcacataaacagaaccaaagacaaaaaccagacaattatttcaatagatgcaaaaatgcctttgataaaattcaccatcccttcatgttaaaaactctcaatagactaggtactgatggaacatattgcaaaataataagagctgtttataacaaacccacagcccacatcatattgaataggcaaaagctggaaacattccctttgaaaactggtacaagacaaggatgtcctctgtaacctcttctattcaacatagtattggaagttatcaccagggctatcaggcaagagaaggaaataaagggtattcaaataggaagagagtaagtgaagttgtctctgtttgcagatgacatgactttatatttagaaaaccccatcatctcaattcaaaaacttcttgaactggtaagcaagttcaccaagttctcaagatattaaatcattgtgcaaaaatcacaagcattcctttacatcaacaatagtcaagcagagagccagatcaagaatgaactcccattcacaattgctacaaagagaataaaatacctagggatacagctaggagtacaagggatgtgaaggacctcttcaaggacaactgcaaaccactgctcaaggaaataagagaggacacaaatgaatggaaaaacatttcatcctcatgaataggaagaatcaatattgtgaaaatggccatactgcccaaactaatttatagattcaatgctgtacccatcaagctaccattgacatttttcacagaattagaaagaactattttaaatttcatatgaaatcaaagaataccccgtatacccaagacaattgtaagcaaaaacaacaaagctggaggcatgacgctacctaacttcaaaccacactagaaggctacagtaaccaaaacagcatgctactgctgccaaaacagacatatagaccaatggagcagaacaaagccctcagaagtaacaccacacatctacgaccatctgatctttgacaaacctgacaaaaacaggcaagggagaaaggatctcctattcagtaaatgctgctgggaaaactggcttgccataggcagaaaaccaaaactggaccccttccttacatcttatacaaaaattaactcaagatggattaaagacttaaatgtaaaatccaaaaccataaaaaccctagaagaaaacttaagcaataccattcaggacataggcatgggcaaagacttcatgacaaaaatgccaaaagcaattgcaacaaaagccaaaattgacaaattggatctaattaaactaaagaccttctgcacagcaaagaaactatcatcagcatgaaaaagcaacctacagaatgggagaaaattgttgcaatctgcccatctgacaaaggtctaataaccaaagttgacaaggaacttaaacatatttacaagcaaaaaaacaaacaaccccatcaaaagtgagcaaaagatatgaacagaaacttatcaaaaggagacatttatgcaaccaacaaatatatttttaaaaagctcaacaacactgatcatcagagaaatgaaaatcaaaattacagtgagataccatctcacacccgtcagaatggcgattattaaaaaattaagaaacaatagatgctggtgaggctgagaagaaagaggaaggtttttacactgttggtgaaactgtaaattagttcaaccattgtggaagacagtatggctattcctcaaggatctagaaccagaaataccatttgacccagcaatcccattactggctatgtacccaaaggaatataaatcattccactataaagacacatgcacacatatgtttactgcagcactatatacaataggaaagacatgaaaccaacccaaatgcccttcagtgctagactggataggaacaacacacaacacagcccgttgggggctgggggtgagggaaggaaacttacaggataagtcaataggtgcaacgaaccaccatagcaaaggatacctttataacaaatctgctcgttctgcacatgtatcctgtattttttaaatttaaaaagaggaaatacatacatacatacatacatgcatacatacatacgtatgtacatacttttgaaaaacgtctatacagcttggatcttcattcctgataagccaaggaacctggagaaacaccagaattctgtccctctgagaatgccggacaggtttaccttcatcaccataaaattttggaacaaatgtggtaactgcaggttctccccacaatgagtaactgaaaattgaggcagtatttcagatcctaaaaaactgatgaagtaattcgccacacatttgggttgtttttgccttttcctactatgaagattgctaataggaagaatagtgtacaagtatctgtttgattccctgcttttagaatcctttgcttgtttgtgtgtttgtctgttccttcttgagacaggatgtcactccagtcagccaggattttccagtttgtaatttttgttgtttccttttgtcaagttttagaagttgttattttatttctattgaattttaaggcatttttagatatgtattaaaacattatcacacaggccgtgtgttacattgcaattattttcatcattcctttaagaaacaaaagatttagcttagatatcttccaatttgtgaatcttttctgattttgacttttttaaaaatgctgtcatatacaagaaacccttggattaaaaatgccatgaatatttctcttttcttgcagtcataacttcggtgtatgtcatcaattagtctctggtttatagcatgttttcttgaaagtgtttcacaatgtattttgggcattgagaatttcatcaaacttaagtgaaggtttcgacattcactattgaagggaatagtcctatttgatgccttattatttgcatatcttgcttccacaagaacacttcacgcaaagacttgtcttctccccaatgccagatcattacaacatgacatggaatcaactggccaaaaatgggaaggttatctctggaatgtctatttgactccattgatcacttcatcttaattaagacaaaaaatatgctgtgttaattacctcacattgttgcaaattctcaagtcagaaaatgtagttataacttcttggcatttagtcactgaaagaatgatcttatctcacagatgcacatgcttggaagtacttctcaaggcatacacacacatccagaaacaaacacacaaatacactcatacacacaaactgtttaatatgtacacaattgttaaatagcattgttatacatgaaataaggcaaatgtttagctactatcctaacccggttccactcctaacatatttgctcataatactgacaagtaaatctgcttcaacccttccatagtcacaatgtaagcagtgtccattaaattctctgaggaatgcaagaggatacaacctaagacaaaaaacttaattgaatcctgatatttcattagtaaatagggtaattgatggataaatgtaatggtctcggtgggtggacagtagttaaataagggctgatgcagcaagataattatttaaaggcgtttgaaagaaattgaaacaggagagtggatgtattcagctaaaataaaatccggaagccctgaaataaatctcattttgcgggtaaaaaaatggcattggaggagattctgggtcaatcatgaagctgtgaaagttgcatcttggaagcaggatccctgtaatgaaacgagacttgtttatcagaggtggtctttcagaggaaaagattttgaagaatggccccttccttttgtgtatttgacgattagatttcatgccaaatttcgggttttaaactctatttaaacgttaaaagaattaactaaaatggcaaaaaaacaagaaattttttgattaggaatcgtcaaatattcatttcttgttagatacagttaccaaacacgacctaccggagagaaacaattgtggagaatggccccttatttttgtatatttgctgattagatttcatagtccatttctcattaggtacagagatcaaagttgacctacccaagagtagagatatccaggacagaactcagggcacggtagaaccacagaatcttgggtgaaatattgctcaagaacaaaaatgtgcttattcagcgtgtttctgtgtgacatgtgtggaaactaaagtgcaatgagcatgacacgaagacagaatatcaattcggctcacctcaaatcagttgtgagcattaaagaaaaccaattcctaggtcccgcttaaagagataagaccatccaacaacctgtgtgaagccaccgcatctggcttgctcatgattctggggatcattctccagaaaatggtggctcctttctccctgtggagcatctttctaagcagtgccctttcttcccccaggacactttacatgaggtgcaggaagccttctgatggagcacacctggcccatgaaaagacaagggaaagaaaaagggccaaaggtcacagtcctctcattacatcatcatccttaaaatcatcctaatttcatgagccctgaagacagggctgtttctttacacctagaggccttggcgccgggcctcaattctgccctgttccttactgtctaagacattttgggaaaatcactagagccaggaccttcattcctggtaagccagagagccgaaagacacacccaaattctgtccctcttagttcagggaacaggtctactttcgtcagcattacaatttttgcaccaaatgtgctaactgcaattccaccatacaatgcataactggaaatggagggaacatctcagatcatgaacaatcgatgagagaatccaggagatacacggcttatttttgccttttccctgtgaaacaagggcaagtattaaaaactttatgctgtcttctatttcactgcctgcttttaaacgtctccgatgtattcttcttgagaaagggcctcactactgtcacctgggcttttctaaggtataattttccttgtttgcttttgtcaaaattagaacattttatttcatatctatgaaatgttgatccattatcacatacgtatggaaatagtatcaccaatgctgtgagataagttgtttttattttggtcaattctttaataaacaaaagcttatagttgggataccttctgatttctcaaggtttttgtttcatgttttcttaaactgccgccgcacgtccgaaaccactcactatacaatgtcaggaccatctctcttttctggcacacataaatttggggaatgtcatcaattagtctctcggtgattgcatgatttccccaaagtctttcacagtctactttgtgcaatgagtatctcttcaaacttcagtgcatatttctaccatttgatgctttattatttggcaacctagcttccacaagagcatgtcaggcaaagagttctcttgttctccactggaaggtaatttcattcgcacagagaatcaataggctgaacgtagaaaggttatcgctggaagctctgtttcattccacggatctctcctttcttattaaagaaaaaaatacgctgtgctaaataccatacttcattgactaatctcaggtcagaaagcacacttccgatttcttgtccttctgtcgctgagaggatgatgatagctgccaaaagtacatacttggaagttcatcccagcacgagcacacacacacataaacacacacacacacacacacacacacacacacacacagacacacacagggtttcataggtaaagatttcttccctgacattcttttacctaaaataaggcaactgtgcggccactgcccaaacccggttacactcatattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattgttttatcgcgcacctgatgggtgggtggggtgttcgcggttggtgggggtgagttctataagggatgatgcggccagagagctcgtcatttgaagactctctcggaagagatagcgtcttgctgcaacctgcggtcccagcagaaaaaccttgtgatccttgttgcgggcgacatgggggacgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactgcaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcctatgtcaaagctcaagaagtccagtggtataaaatggatgatgccgaggtcactgtctgtagcatcatttctgtcctgagtcaacaggcctatgtcctcttttacatccagaagagtgaatgggaaagacacagtgagagtgtgtcaagaggcagggaaccaagagccctcggcgctgaagacacagacaggcgagcaaagcaaggagagctcaagagagaccacccctgcctccaggcacccgagttggacgagcacttggtggaaagagccactcaggaaagcaccttagaccactggaaattcctgcaagagcaaaacaaaacgaagcctgagttcaacgtcggaaaagtcgaaggtaccctgcctcccaacgcacttgtgattcatcaatcaaaatacaagtgtgggatgaaaaaccatcatcctgaacagcaaagctccctgctaaacctctcttcgacgacccggacagatcaggagtccatgaacactggcacactcgcttctctgcaagggaggaccaggagagccaaagggaagaacaaacacagcaagagggctctgcttgtgtgccagtgatctcagtggaagtgccgacccacacgtaggggtgcacgcacacacacacacacacaaatacacccacaagcacgcacgcaaacacacacacacacacccccaaacaaacccgaacaccgtcaatcctacataaagtaatgaggagtccaagtttctgtctctacaacagggacaactggatagtgatggctgtatctcaggatgagcccacacatgggaaacatcaagttttggggtcgtgagtcttccgaacctctggagggactgtctgtgtgtttgtgttcatggtagatgacattcactgtgtatttctgaatatgacctactgacgtgtaggtttgcgtgtgaggttattgcaggggactcggtttcctattttctcttggggtgtgtttcattcgtcagttgttgggcggcacgggaaggtgaaattttgctcatgtggcacatccgtggatcattctcgccaccttgaatagtggaaactggaatgcatttagaagataggaacggtgctcttctttcttaccctggctcgccgtttttacattggtttctgaagggacctcaggcgccctgggacttgtgctcttgctggaacccacataacgccggaaacagacagaccgacttgcctgtttcacggggtccacttccaatgagtcgaaacggaaaattttcccactggcatgtcagtcatttggaactaagtcctattgataataaaggaaatcaaacacaggagtgtgtgtattcaactgaaataaattcagaaagccctgaaaaaaaatctcatttggtgtgcttacaaatggcatttggggagattccgggtcattcgtccagctgcgaaagctacacctctgaagcacagtccctgtccttcaatcagacttacgtatccgacgtggtgtttccgtggaaatgattgtgggaaatggccccttccttgtctgtatttgctgattagatttcatggtccctttctcgttaggtgcagtgatcaaagttgaccaaccccagaggaaagctgcccagggcaccactcagggctccgtagaaccacagaatcttgggcgcaaccctgctcaagcacccaaatgtgcatacgaacagggtctccgtgtgacgtgtgtgaaaactacagtgtgatgagcatgactcgcagacaggttatcgattgggctcccctcaaaatcagttaggaacatgaaagcacaccgatgcccaggtcccggctgcaggaataagaccctccgacgtcttgtgtgaagccacggcatctgcgttgctcatgcttctggggatcattctcctgaaaatggtggcttctttctccctgtggagcatctttctaagcagtgctcctttcttcccccaggacactttacatcaggcgcacgaagccttctgatggaccacacctggcccatgaaaagacaagggaaagaaacggggccaaaggtcacagtcctctcattccatcatcctccttaaaatcatccgaatttcatgggccctgaagccagggctgtttctttaaaactagaggccttggcgccgggcctcaattctgccctgttccttactgtctaagacattttgggaaaatccctagagccaggatcttcattcctggtaagccagagagcctgaagacacacccaaatgctgtccctcttagttcagggaacatgtccactttcgtcagcattacaatttttgcaccaaatgtgctaactgcaattccaccatacaatgcataactggaaatggagggaacatctcagatcatgaacaatcgatgcgagaatccaggagacacacggcttatttttgccttttccctgtgaaacaagggccagcagtaaaaaggttatgctatcttctgtttcactccctgcttttaaacgtctccgatgttttcttcttgagacagggcctcattcccgtcacccgggcttttctacggtataattttccttgtttgcttttgtcaaaattagaactttttatttcatctctatgaaatgttgagccattatcacatacgtgtggaaatagtatcacccatgctgtgagatacgttgttttgattttcatcagttctttaataaacaaaagcttatagttgggatacctttggatttctcaaggtttttgtttcatgttttcttaaactgccgccgcacgtccgaaaccactcactatacaatgtcaggaccatctctcttttctggcacacataaatttggggaatgtcatcaattagtctctcggtgattgcatgatttccccaaagtctttcacagtctactttgtgcgctgagtatctcttcaaacttcagtgcatgtttctaccatttgatgctttagtatttggcagcctagcttccacaagagcatttcatgcaaagacctgtcttgttctccactggccggtaatttcactcggatagagaatcaatagtctgaacgtggaaaggtcatcgctggaaggtctgttggattccacggatctctcctttattattaaggaaaaatatacgctgtgctaaatactatacttcattgactattctcaggtcagaaagtgcacttcagacttcttgtgcttccatcgctgagaggatgatgatagctgccaaaagtacatacttggaagttcatcccagcacaagcgcacacacacacacacacacacacacacacacacagagacacacacacggtttcatagataaagatttcttccctgacattcttttacctaaaataaggcaactgtgtggccactgtcccaacccggttacactcatattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattgttttatcgcgcacctgatgggtgggtggggtgttcccggctggtgggggtgagttctataagggatgatgcggccagagagctcgtcatttgaagactctctcggaagagatagcgtcttgctgcaacctgcggtcccagcagaaaaaccttgtgatccttgttgcgggcgacatgggggacgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggatattacttctcttatgtcaaagctcaagaaggccagtggtataaaatggatgatgccgaggtcactgtctgtagcatcacttctgtcctgagtcaacaggcctatgtcctcttttacatccagaagagtgaatgggaaagacacagtgagagtgtgtcaagaggcagggaaccaagagcccttggcgctgaagacacagacaggccagcaacgcaaggagagctcaagagagaccacccttgcctccaggtacccgagttggacgagcacttggtggaaagagccactgaggaaagcaccttagaccactggaaattcccccaagagcaaaacaaaatgaagcctgagttcaacgtcagaaaagttgaaggtaccctgcctcccaacgtacttgtgattcatcaatcaaaatacaagtgtgggatgaaaaaccaccatcctgaacagcaaagctccctgctaaacctctcttcgatgaactcgacagatcaggagtccatgaacactggcacactcgcttctctgcaagggaggaccaggagatccaaagggaagaacaaacacagcaagagatctctgcttgtgtgccagtgatcagagtggaagtaccgacccacactgaggggtacacacacacacacacaaacacaaatacacccacaagcgcgcacggaaacacacccacacccacacaaacacgaacaccgtgaatcctacataaagtaatgaggagccccagtttctgtctctacaacagggacaattggatagtgatggctgcgtctcaggatgagcccacatatgggaaacatcatgttttggggtcgtgagtcttccgaacctctggagggactgtctgtgtgtttgtgttcatggtagatgacattcagtgtgtatttcttaatgtgacctattgacctgtaggtttgcgtgtgaggttattgcaggggacatggtttactatttcctcttggggtttgtttctttcgtcagttgttggtcgtcaagagaaggtgaaattttgctcatgtggtacatccgtggatcattcttgccaccttgaatagtggatactggaattcaattggaagataggaacggtgctcttctttcttaccctggctcgcccattttattttggtttctgaatggacctcaggtgccctgggacttgtgctcttgctggaacccacataatgcgggaaacagacagaccgacttacctgtttcacggtgtccacttccattgcgtggaaacggaaaattttcccactggcacggaagtcatttggaactaattctcattgatactaaaggaaatcaaacactggagtgtgtgtattcatctaaaatacattcagaaagccctgaaataaacctcatttggtgtgtttacaaatggcatttgaggagattccgggtcattcgtccagctgcgaaagctgcatctctgaaacacagtccctgtcctgcaatcagacttatttatccgacgtggtgtttctgtggaaattattgtgggaaatggccccttccttttctgtatttgctgattagatttcatggtccctttcttgttaggtgcagtgatcaaagttgaccaacccctgaggaaagctgtccaggtcacaactcagggctccgtagaaccacagaatcttgggcacaaccctgctcaagcacccaaatgtgcatacgaacagggtctctgtgtgacgtgtgtgaaaactacagtgtgatgagcatgacttgcagacaggttatcgattgggctcccctcaaaattagttatgagcattaaagcacaccgatgcccaggtcccggctgcaggaataagaccctccaacgtcttgtgtgaagccacggcatctggattgctcatgcttctggggatcattctcctgaaaattgtggctccttcctgcctgtggagcacctctctaagcagtgccctttcttcacccaggacactttacatcaggcacagaaagccttctgatggagcacacctggcccatgaaaagacaagggagaagaaacggggccaaagatcacagtcctctcattccaccatcctccttaaaatcatccgaatttcatgggccctgaggccacggctgtttctttacacctcgagaccttggcgccgggcctcaattctgccccagtgcttactgtctaagacattttgggaaaatccctagagcctggatcttcaatcctggtaagccagagagcctggagacacacccaaattatgtccctcttagttcagggaacatgtccattttcgacagcattaaaattttggcaccaaatgtgctaactgcaattccaccatacaatgcgtaactggaaatggaggcaacatctcatatcctgaacaattcatgcgagaatctaggagacacacggcttacttttgccttttcccactgaaacaagggccagtattaacaatgttatgctatccttggtttcactccccacttttaaatctctcggatgtttacttcttgagacagggcgtcactgccgtcacccacgcttttctacggtgtaatttttgttgtttgcttttgtcaaatttagaaattttcattcatctctatcaaatgttgctccattatcacatacgtatgaaaatattatcacgcgtgctgtgagatacgttgtttttattttcatcaattcttttgtaaaacaaaggttatagttgggataccttctgatttctcaagttttttgtttcatattttcttaaactgccgtcgcacgtccaaaaccactcactatacaatgtcttgaccatctctcttttctggcaaatataaattttcggaatgtcatcagttagtctctcggtgattccattatttccccaaagtcttttacagtctagtttgtgcactgagtatctcttcaaacttcagtgcatgtttctacgacttaatgctttattattcagcaatctagcttccacaagagcatttaatgtaaagacttgtctttttctccactggcaggtaatttcactcggatatagaatcattaggctgattatggaaaggttatcgctgggaggtgtgattgattccacggatctctccttttttattgaggaaaaatatatgctgtgctaattactatacttcattgcctattctcaggtcagaaagcgcacttcagacttctccttctatcgctgaaaggatgatggtatctgccaaaagcacatactcggaagtacatcccagcacaaacacacacacacacacacactcacacagagagagacacacacacggtttcatagataaagatttcttccctgacattcttttacctaaaataaggcaactgtgtggccactgtcccaacccggttacaatcatattatatgtgcctatcatcctgaggagtaatttgatgcaggtgttttagaagtcatgatgtgggctgtgtctgttgaattcccagcgatgcaaggggacacaccctgtgactcattccttaattgagtgctgatatttgattggtttatcgcgcaccttatgtgcgggtggcgtgttcgctcttggtgcggatgagttatgtaagggctgatttggccagagaactcgttatttgaagactctctcggaaaagatagcgtctttctgcaacctgcggtcccagcagaaaaaccttgtgatccttgttccaggcgacatggaggacgactcactctacttgggaggtgagtggcagttcaaccacttttcaaaactcacatcttctcggccagatgcagcttttgctgaaatccagcggacttctctccctgagaagtcaccactctcatcggagacccgtgtcgacctctgtgacgatttggctcctgtgacaagacagcttgctcccagggagaagcttcctccgagtagcaggagacctgctgcggtgggagctggtctccagaatatgggaaatacctgctacttgaatgcttccctgcagtgcctgacatacacactgccccttgccaactacatgctgtcctgggagctctctcaaatgtgtcatcgtcccaagtgctgcatgctctgtattatggaagctcacagcacacgggcacctccaccgtcctggccatgtcatccagccctcacaggcattggctgctggcttccatagaggcaagcaggaagatgcccatgaatttctcatattcactgtggatgccattagaaaggcatgccttcccgggcacaagcagctagatcatcactgcaaggacaccaccctcatccaccaaatatttggagggtactagagatctcaaatcaagtgtctctacttccacggcatttcagacaccttcgacccttacctggatatcgccctggatatccaggcagctcagagtgtcaagcaagcttaggaacagttggtgaagcccgaagaactcaatggagagaatgcctatcattgtggtctttgtctccagaaggcgcctgccgccaagacgttaactttacacacttctgccaaggtcctcatccttgtcttgaagagattctccgatgtcacaggcaacagacttgccaagaatgtgcaatatcctgagtgcgttgacatgcagccatacatgtctcagcagaacacaggacctcttttctatgtcctctatgctgttctcatcgtcaccgggtggagttgtcacaacggacattacttctcttgtgtcaaagctcaagaaggccagtggtataaaatggatgatgccgaggtcactgcctctggtatcacttctcctttgagtcaacaggcctatgtcctcttttacatccagaagaatgaatttggaagacccagttacagggtgtccgcaggcagggaaccaagagctctttgtgctgaagacaattgaattgtgtgtgaaataatatgtcatgaataaatcttgcagcagagtatttatttgtctcactttgtaatcagtgaatgagctttaacgaatatcaatgcctagtgcctaccccccagagataagaactttcagtctctcatgtgtaatcatggcatctggattgctcatgattctgaagataattctcctgtcccccaaagtttcagaatcacttcaggtggtagaaacagataacacatcagtccctttctctctcttttctcttcactcaggaaaactctcactggaccaaggaaaatcctatggtttactagggaggagtagttttctcagcagtgaaaatggtggctccttcctccctgtcaagtctcttcctcaggattgcccctttatctctccaggactctgctcatcaggcccgagatgccccctggttgcgcatacttggcctatgaagaaatatggggaaggaatggttccaaagaccatactatgctcactccaccatcgcctctgacactatgctgacttcatgagccctgggtcagaagctgttttctttacacctctaggccttgcctcatggcctaaagatgtccccatttcttacatcttataaattttgacaaaaccctcagggcctaaatcttcattcctcataggccaaagggagatacaccagaattctgtccctctgagactgcaggacatctcagcttccatcaacatgaaattttgcaccaaatatagttactgcagttccacctcacaatgagtaactggaagttcagacaacatctcagactctatacagtttctggccaagctcatttggtttaacaatgcttttactctataaatcagttgtgagaacacttaggattcatattatttagtattttaatcagtctgttattattttcaatgtgtttactagactttagtttaatatttctgataaactttgatgcaaaaattctcgatataatagtggcaaaccaaatccagcaacatatcaaaaaccttatccaccaagatcaagtcagcttcttccctttggtgcaaggctggttcaacaaacacaaatcaataaatataattcaccatgtaaaccgaactaaagacaaaaaccccatgattattttagtatactcagaaaagatctttgataaaattcaacattcctttatgttaaaaacctcaggaaactaggtattgatggaacatatctcaaaataataagagtcatttttgacaaacccacagccaatatcatattgaataggcaaaagctggaagcattccttttgaaattcggcacaaggcaaggatgccctctctcaccactcctactccatatagtactggaagttctggccgaggcaatcagccaagagaaagaaataaagcatattcaaatagtaaaagaggaagttgaactgtctttgtttgcagatgacatgatcctatatctataaaatcccatcatctcagcccaaaagattcttaagcttatgagccactgcagtaaattctcaagatacaaaatcagtgtgcaaaaatcacaagcattcttatacaccaacaatagacaagaagagagccaaatcacaaataagttcccatttacatttgctgcagagtataaaatacctaggaatacagctaacaaggcaagtgaaggacctcttcaaggagaactacaaaccactactcaaggaaataagagaggacacaaacaaatggaaaaacattccatgctcatgggtaagaagaatcaatatcatgaaaatgccatacttcccaaagtaattcatagattcaatgctattcccataaactaccatggacgttctttacaaaattagaaaaaactacttcaaaattcatatggaatgaaaaaagagcccatatacccaggacaatcctaaggtaaaataacaaagttagaggcatcatgctacctaacttcaaactatattacaaggctacggtaacccaacagcatggtagtggtacaaaacagacacatagaccaatggaatggaatagatatatcagaaataagactgcacatctacaaccattttatttttgatgaaaacaagcaatggggaaaggattccctatttaataataaatggtgcttgaaaaattggctagacataggcagaaaactgaaactgtaccccttccttataccttatacaaaaatgaactgaaaatggattaagacttaaatgtaaaacccaaaactgtaaaaaatccaaccccatataaaagtgggcaaaagctgggtacagtggctcatgcctgtaatcccagcagtttgggagggtgaagtgggcagataacttgaggccaggaattcaagatcagcctggccaagctggtgaaaccacgtctctactgaaaatacaataaattagccggatgtagtggtgcggacctgtaatcccaactactcaagagcctgagagagaagaatcgcctgaatctgggaggcagaagttgcagtgacccgagattgtgccactgaactccaccctgagtgacagagcaagactctgtcttaaaaaataaaaatgtaaaaatttcaaaagtgggcaaaggacatgaacagacacttctcaaaagaagacatttatgcagccaacaaacatgaaaaaaaagcccaacattactgatcattagagaaatacaaatcaaaaccgcagtgagataccatctcatgccagtcagaatggtgattattaaaaagtcaaaaaacaacagatgctggtgagactgtggggaaataggaaaacttttacactgttggtgtgaatgtaagttagttcaaccactgtggaagactgtggtgatttttcaaagacctagaatcagaaataccatttgacccagcaatcccattactgcatatatactcaaaggaatataaattcttgtattataaagatacatgcatgggtatgttcattgcagcactattcatgaaagcaaagacatagaatcaacccaaatgcccatcaatgatagactggatacagaaactgtgatacatatacaccatggaatactatgcagccataaaaaggaatgagatcatgtcctttgcagggacatggatgaagctggaagtcattattctcagcaaactaatgcaggaacagaaaaccaaatacacatgttctcacttaataagtgggagatgaaaaatgagagaacatagacacagggaggggaacaacacacactggatcctgtctgtgggtgagtggggagggagtgcatcaggatgaatagctaatgcatgtgggctgaatacctaggtgatgggttgataggtacaggaaaccaccatggcacacatttacctatgtaacaaacctgcgcatcatgcacatgtatcccagaacttaaaatgaaataaaataaaattttaaaaaactttattttttctaaccttccaaaatgcagggattacaggcataagccaccatgcctggccctgttttaacatatctgaacaagatttaagacatcagtttgaaaagagcccctctatggcagcaacatgaattctgtcaaacctgaagcaagaacaaacatcaaatttacggtgaagctggggtacaaaaaatggtgaaataaattattctttatgaaaagtctatgggaaaaatgacctgaagaatcagtcatttacaaacggataccttattctaagaagagataatacaatgttgaagatgaagtcaacagaggagggacatccataccaatttttgagaaaaaaaaatcgtttctatgctctcattgaggaggattgacaattaacaagagatactgtagccaacatcacagacatctcaattggttcagcttacacaatactgactataacgtgaaagttgagaaactttacatttgatgagtcccaaatacccttgtgcctagatcagcagtggacaaaagcagagctattagtaactattttgagcaagcagaatcaagatcctgaagcattattttgaagaattttaacagggagtgaaactggctttatcaataagatcctgaagacaaagcacaattcaagccatggctaccaagaggtagaagtggtccagtcaaagcaaaagcaaacttctcaaaagcaaaagccatggaggttttggggatgctcaaggtattttgcttgttgactttttgtaaggtcaaagcacgataacatctgcttactaggagagttcttagagaaaattagcaaatacttttgcagaaaagcgccctgtaaagcttcactagagagtccctctgcaccacaacaacacttctgttccttcctctcatcaaacatgggtaattttgcaagagttttcatgggaaattattaggcatcaacattacagtcctgatttggtttcttctgacctttttttccctaaccttaaaataactgtataactgtaaagggcacccatttttctttagttaataatagaagactgcattgacacggttaaattcccattaccctcagttgtttagcaatggactgaatggctgggatcatcctttaatggagtgtctggacctcagtaaagcttatattgagaaataaagtttatatttatatttttattgttaattccatttttcactgacatttttaaatcccttcacaattcacctttgtctcaaaggtatttaaatttagaaatcatatcaagtgtgaaataaaaaaattatatagacagagggagaacagaatctataaatatgcatgtttgtgtacatacatccatatacatacatatgtgtgtgcatgcaataattttattgccctaaagcaatgcctctgccttccaccctcactgcacatgtcctagtcctgtgatgtccctggaactgagcacctgatttccttctctgcctcccacatgaacagggaatagaaatggaaaccacgttctgtggttgctgttgtgaaaatccatgttccccacaggctgagtttagcatcttacattctagttctcattgtaaaaaagcaagcaacaaacaaaaactacaaaagaaaaaatgaaatagttgaaagtctagagccacagaggttccggatccacccaccgcccacggtgacctccacagccctccaggcctgaggacagctatgcctgaacagcctgcctcttcaccatccacacaggaaagtgactttaaacttcaatagctattactctgttccacaaggaaccaggccaacattcaaagtcagtggtctgacaactctaagctttggccggaaagtattggaaacatttaacgtgcagtggatgaagcagcccggccccactgcacacaacacactcacagggactcaaaggaagagactcaggatccgctgggtggaagtgaggacagacccagaaacacagggggtgggaaggggtcaaaccaggaaggctcaggacctgacctcctcctaggccctgcctctctagaactcgcagttttttctgacctagaagcggatttcactgatggaaaagaagttcagtatttctggtccagcccagtaagctgctcccattgcccagccttccacaccactgcagacgtcacaatccctgcacccactaacctgacaagggagctatgcatcacctggagacagtcttaggcctgcactcctgtgatggggtccagggtctgtgtccatttctggttaaaattgctgtaaggctggtcgctgtcttggccttccctgcttcctctctgttcaattctcccctcctcaccccatgtgaagcttttactcaggagatggattctcacccctcttgaaacatcaaggatagtgccaggacactgcaccatccccttgaccctgggattctgtagacctcagtcttctcctgaggtcccctccctccctacctcattttttccatacttctggggcctgggcctgctacacctcaggcttcctcttcacagtcacagagtgagggagcccccttcatccttgggctctggccacagctcacctgctgcaggacactcagcagctttcagtagttcatccagacatccagttggaagtgagatttcctggaaggaaagcaggaacccagaattacactgaattctaacaccagggcccaggttccccttctgcatgggacactaagctgcaaacactacatgggcacttaatgctcagctgtccttctaacatctggtccgattgtgtccctcctccttggaatatctcagaaaatgtatctccacctagagttctttgaaagcatcatcctatgtgattccagaccatcagggggtgcaatgggtcctcaccagtatttccactctgcttggaagacttagaaaatcctgaggctgctcagagggtcagcttcccatcgctgtgtttcagtaaaacttcagtcttccctggacaagtgaggagacagaaaatgtctagtctctggcacatcttttgcaagcaatggcggctcccaggaatcaatactatcaacgaatatatttttgagattctggtcaaaagaagagtcatcctgcaatttcaggtaggatggagtggttctgtggctcctgaggtgattttgaaaagatcttgactctcagaaggaccaaggaggacatttctggcatttccagaccaggaagagtgactgatggacctccagtgttacttggaaaaattttgttggacagctttgtaataagaggatcttgctttggctttcaggccttcacataggttgtttagatcatggaagtgtttctgcatttctgcataggctcaggatgccttctcaagtcgtccctgcaattatgagacagttgctttctccagaggtcacttagaataatacaagaggcttcaccctcaaagggacaccagacaatatagccacagtccagccaagattatctgtatttacatacctgtaaagtaacactcctagtgatctccattaacttggacatctttcatgaatagggaaactctagtgattgttatataacagctgccacaaaaattaatcaataaaaagaaacgatatatgaaaaataattaataatcatgataatgaactcaatgacctaaatagtatgaattttaatactggagacaatataaatgtaaggatacaaaaattaatgtggagcttcccctaaatatatgaaaacttcacagactgtgtcctccttgtgtaatttggagtcagagtcaaagaatttctctatgaaatgtgttccatgatggcaaacatcaaaaacaggaggtgaaagaaaagcaagccgcaggagaccatgggctaatatgaacatttgtgtgcaaacctctctcatcaagaactaccagccagaggtgaagggactgtgatttgtgtcctgcccaccactgggcacacaaaagctttcagtagtgcaaccagatggctggtttggcctggctccctgcaaggaagacacgtctctgatccccaccagcccatcagtcctggaactcagaatcctacatgcagtaaacatgaagctccaactccatagctgactttacctccttactgtccttctgccatctggtgtttcaggtgctctccagatctggacttcttggctcccctacctttaccaagtgaactcaggatgtatcattctcagtcttctcctgccagtccaaagtgaaactcaccaatacaagcataccctggatgggctttcttggaatatttagaaaacaatgagcttgctcgggggtggtgtgagctctaggagtagagttacagtctcccatggaaacctgagaggacttagaatattcccaaaggcctaagcagtccaatctgtcctggaaacatcaggaatgatatactcggtcttcctgaggctccaaaatttttccaaataaactcagagattacagaaccatttttctcttgggaactgaagtggagttatttgccttctgccagcatctcacttttttttttctctaagttagcttttgagcccagaagtagatattccttgtatttgatttacatagggagcttcctagaatgcccgtgcctctggatagtttctgcattcactcaggtattgacaaaatgctgcagttctactgaaaatctctgagatgaccatttgatcacctgagtaacttttgaatgtgtcttctatggaagccctggagcctcccttctggtatttcatacactgccggtaccaagtatcctgggtgaaaccctccatcagacattgttggcaattccagtatggagatgacactaacgtgatggggctcaagaatcagatggtagaagagcagctgggaggtgaagtctcagtaggctaggggcttaatgttcaatgcacaccagacttctgagactcaggaggcatgtgtggatctgtctgcccagtgtctctcatctacagcctggaccagctatttcttggggtgaactactgaaggcttttgtacgacctgtgtcaggcaagactctggccagaccctttgccatagtccatttgtaatgcatttccacatggcacaggtatctccacttttgcccatgctctcatgtggctcagaattattctccctactgccactcttctttgccatcacagaagatatttcaaggtgtagccctaagcttctccatctaatcaataacatgagggttcgtatgggaacattgtcacaggcttacaggaatatgttcttaaatatctgcttttctattactctcttcattaaattgacatttatatcatcaccattatgattgttattaatgttattattatattgatacagttctttatcatggatatatttgtggtcgtttttatgcaatgttgaataattgttttatgttcctgaagactgttgaatttgctgaagatgattaaaagacaaccttaaaacataaataccacagcaaccccaggaatcctactgtactgcttggtgtcctgtagaagaatgggcttcctgaattattcttttatttttcaggcaagtacctattcataccagcataggagactgatgaagtgcaccctcatcttgccatggtctcagaaagaattcgtacatatgctttatgtgatagcaactctatgtgtaggcctgtgagccctagaatgcactttctttcaccaactagtccacctaacagttttctaagtcaaatcccctctccatgcttggataggtcatgaatggctttctgttacccacctaagatgaagggatattgctaaatcaggtttgtggccaagaaacttttatctggagtggcaggagagggcctacctgttcaccagagtgtctgcaacattttcttttttttcctttttatttatttatttatttattttttgagatagagtctcactccgtcgctcaggctggagtccagtgtcgcgatcttggctcgctgcaacctctgactcccaggttcaagcgattctcctgcctcagcctcctgagtagctgggattacaggtgcgtgtcaccacacccagctaatttttgtatttttagtagagaggcggtttcaccatgttagtcagactggtctcaaactcctgacctcatgatccacctgcgttggcctcccaaagttctgggattacaggcataaggcgccgcacctggcctctgcaacattttctaagtcggtatagaagctctttgaaccaccttttcagtcaaagaactcatgaaaaagtcctccaagaacttgtgaccttctggaaattgtcaaaatctctacaggtgtccagagtcatctagatctgtattgcaagccactgactgggttccaacattattaaagcaaatgcaaaatatgccatgcccaccaaaaaaaatccagaagccatggtatttagctgtttccatctttcttgcctcctgcacgtgggagagtactgagtatcatgccctcctacagcctctggaggacatgccaatgtctaggggtaccagtagagaggggccatgaaagacagatgacagccaggttgctgggaatgacattgtcctggggcttattgcttgtcatgaactctgccactgggcaacatatgcaggtgtggacccgtgccttctctggatccctgccccatcagccagctgtcttatctcctgaaagctgataggtgttggtcagcatggtgttccaggaccagggttatattaacattctctcttaggctgaaacaccagaagttaacacaggagtccccaggtgtgcacatactgacctccagattgtttttcttctcgttctagatgttcatccttgctttttgggacttgaaataaccctacacagccaaatatttatgcctattatccacttatggaaaacttatatgtcccaagtccatagggttagtattattatcactattaaaaccattagtactagtatcatgatgatcattattcctgttaatatccatcaatatttttactactgccattgttaatatggatttttcattattgtacagcaatgaatatagtttatccattcacaaatggtgttcagttaccaaagatgactacaaggcatgttctacagacatatacacacacagctgtcctggagacccagctttgccaccaattgctctttcataagatgagatcccccagtacccaccagtttttcaggactcgacctgagctggctcagctagacctggaaaagtttcctatgcccaaatgtacttggaaaaattttaaagtctcttcagaggcccagtaatagcttttggcagcttctaagaccagggagggtttcttggccattcagagccattcaaatattccaagtaaactcaaggatccagaaaccccacttgcagtcatgaaataccagtgaatggcctctgtgagtctcttcaaggttttcaaagatgactgcctgagaaggctggccaggaagtcacccaagcccaaccttctgcaggacgttctatgacagccagggacccagggaattgccattgaacagaagggaggaacagagacggcatgcctgagcttctggaaacattctaagtgcccttgttggcccagaaaagactggtgctaccatatgaggcacagacttggcaacctacctactccaggaaccacagaaggtttaaaggttcccaggaagtcccaggaagggcagccatagccctttagagccatcagattttattctaagtctacttgggagacagtgctcttagcttcataaaaacaccagtggaggtgctaacacttgccccagtatccagtcttttctacctcatctcagagccaggaagccactatttcccaaagctgctgtgcaatgaaaggggaatattctaggtgctctcctgtgcccacgaaattctgtggctgcgctgaaaggcaggagatgtcctccggaatgctcttcagaaatctgacaacactggtcaagattaaagaagctcaattcaacgtcatacaaaaccaatcccaaatatatatatatgcatagtgagacaaaatgatgaacacatctgctaataatcatgaatgacaataataacaacaatgatgatcttagtgataatgccaccaacactgttaatggcaataacaataaacctgaggtaatgagtgttagggtcccgattcaccgatgtgaaggatggcggcaatttctggcctcacagaaataaaggaaaagtaaacacctggaggaggaggaggtgaacctggagctcccgccggcctctgggcgctccttggtggaaggagagggacttggtcctgagcctgccccggatccacctacaccagaatcccagagtcccagtccctggatgggctcagtcccaaccaggccagacgccccggagccccgtagcccgggtcctccagccctcgctgccgccgcttctcgcggagccggggccgcccccgcgccacctcagcctctgcggggctctgggagggcagcgccgaggatgctccggggccagcgggggcatccgggcccagagggggtatccggcctcaggcggatactgacgccctgagggcgcggaatagggcggcctgcgcagggcccgccgtctcggccttgcaaaaacagcggcctcttcaaagcccctaccggaacctccccggaggccccagcctcaaagccagggcgatggcgcttccctgaccatgggtgaagaaaactcaggtcctccctggagacccggcccgccgcgggaggcagaccgcgcatgcgccctgcatggccggaaagatgggtttcattgccctctgtcggccatgaggtggcagcacaggacgtttggccttagcggtggacctgagtctgaatcactgaaattcaggtgtagattattcagtacttttcttttggaagatcaaatggaaattgagtatgataccttgtgctttaattaaagaagatggaaataaagaagcaaattcaaaaatcagtatacaaaagccgattgattccctctatgtggagggaagacgagcttgaataagagaagcattctgtgttacgctttaataatggctggagatctgccaccatgcatttgtcaaatcccatagaatttcacagcacaaatagtacatcttaatgtggttcaggagtacatataatgtcagtcacagtttgtgggtaaattacatatttaattaaatagattaaacaataaataatgatatgagctctgcctggacacagtccttgcctctccaaccagtttgccaagggcttgaatttcttgctcattatcctcacacttgacataaaccctggctgcagagtaaaatcaatcacttgtagagattttaaaatataatgatgtgtcaacttcaaccatggataaggccatttagccttagtaaggccgatcgtattaagattgtgcctgtttggcaaaatttcaagtcatcccacttaatattcaggaaacattttctcttcagttttaggttcagtggtgaggctccttcacggacaatacatttttcaattctgaggacaaggcagaggagggcccctctgtgagaactttcattttgcttcaggaaaagtacattgaatcaaatataggaaaggcttgcaaggtggctgacaggttcggctgttttatcatgctggtgttttatcttctggactgcagtaaaaggagcacagctgtgtctgtctctgtgtaataactcaggacttaccagaataaaatgtggggtgttatgagatgaactgctacttccagttagagaggctccagggacaaaatttcaagagtcttctgagggatagaagagaagagctgccttattctctgatcccagttaactgcctagagacagaggaaagggctgcggacacccaaatgcatatacaaggtgtctttgatacagcctccatttccctgctaaatctatgcaatgacacactgagaaatctagcaagtggggctgaagatccctggtgtgtcaactcgagggttggatggaaacaagtggttttagtggacgttgaagtaaagggaggtgagctgtgaggaaagagctgttgaagactggggagactcagaagttggggtagaatctcgaccaagaatctcacccaaggagtgcaggtgcaaatccatttgttagggccgcataaatgaaacaagggctttgccaacatactaagttttttcaacaacagattgtattctttcaatatttgtaagtattgatcttttggaaaagtttaatgagatttcttatataattctgcacgcaatttattccctggtcactttgctattatgcatttacatgccacatttttatgaatagatattttctcaaatttctgaattattttgctaaagtatgtgttaagagttttttctaggggtccaacttcttgactcacttttctgatgagaaatctatcaggtttctccacagtgattttcaagtttgatagctcctcaatgtgagaaactcaatgtcaactaagaaatgaattaccactaaagaattttctcctttcaagatgctaaccatgttttgtccagtgagaaatctcacatgtgccacatgtgttgctctatgaagaaaggatttctcatgatttttcattgcataacttctccagtaagaagtatttggtattccaagagaattcattgcccttggaaagattttcccttcttatttagctcatgaaggctttcctctcttattttccattttagcagcattttgtcactcttctcttgtgaacatcaagcctggtgcttggctgaatgttcattcacagaaaatacaaataaagggttcatccaagtaaagttttctcatgttatttgacaataaattgcaaataaaaacattttcacactgaatgcagagttagagattctctacctgaaagtcccacatgttttaagttatagctgttgctgaagacttttagttgattatattgacagtttcagctctctcatgtcacttatgctcagatcactaacaagtctttggtacatacatgtcatacaatttctcttccatatgaatttattgatgtggactgaagaataaaggtaactgaagtatcttccatgttgattacagtatttcttcaaaatgtgagtcctttggcatgtttagatgctacaactacagctgaagtctcttccacattccttacctttgtcattcctaacaccgtgtcatctaaagtcagaatatgttctgaagaagtttataattttctctccagggtgaattttctgatgctctttaagattagtacattgtctgaaggctttcccacataaatggcattcatatggcttttctccagtgcgtgttctctcatgtcatctaaggttggaagacagactgaaggccttcccacatagaagacaagcatgtggtttctctccagtgtgaattattttgtttcctctaaagccagagctttgactaaaggctttcccacttttatcacattcataacacttttttccaaggtgagttctctcatgtctttgaaggttaaaggattgaataaagactttcccatattgatgacacttatatggtctctgtcccgtgtgagttttctcgtgtcttctaaggtgagaacactgagtgaaggcttttctacatagatgacatgcatatggcctctctccagtgtgagtcatcttgtgccgtctaaggtgaaagcaattagtataggccttttcacatagattacactgatatgatttacctttagtatgaatttgtttatgtggttcagtggacaaaagattacgaagggattttccacactgtttgctgacatagggtttctttccactatgagttaacaaacactgagttattgtggaactgcgagtgcaatcttctcccgaatcattacattcaaaaggatcctccagaatgagagagttctcctttggggcaaatattaaaagctcttaatggtttacccacatatatctatacattcatttcactacctttgaatcctagaccaaccattcagtggtagaccccagttgaaagctttccaatgtttcttgtgtgaaaggaaattaaattttgggaccccaaactcatttaaccaaagggaaaaatcaagctgggaactgggtcacacaaacctgcctcccccttctggttcctaaataatatggctacaagatgaaaagctacacgcctcccccatattttgcccatgaggaaattcctcatgagctgttaaaattgcaccatggcaatgcaaactgataacttttctttacaagtgcagtcatccccagttcaccaggcacaaatgcatattgattgtctccctgccccattttgcctatgttgtcttatgtaaaatgcagctttcctgcattattcctctgcctcatttgtttatgtcatcttatgtaaaaaaatccagattcactgagccagaaaaatgcatgaatgactattttttctacccaccttttacatgaaaattgtgtacttctcaatatcccaccctttcccctttaaatttggagccttcaaaatcatctttggagaaaggcatacacctgtcccctgggtgcatgtccttaactttggcaaataaatctcctaaaatgattgagacttgtcttgtcatttttctcgattgacaattgcatacacattatctcctgcagacacagatatgttctcttctgtaacatctcaactgcagcgttattgcataattgtgttgatatcaatatctttcgatgactgggcatgagcaatgtatatgcacttgttctattttagagatctcatgttatggtttagaacacaggtcaatgtattcactaaattcaaagtatccaattttttttttttgcttagaaaacacttaatgccagcttaattacactcaggtgattgtgcttcattactaacttaatccattaacatgtctttaacttagatgactggtgtacacagctataaaacttaccattgtcatactggtggatgcgtcttttctggtgataggatgcatggatatcatgtgtgttttcttaagggcactttccctgtctgaaataattgaaaaataaattgttacattggtattatggtaataaaattgtttgaaaagccccaaagcccacgtacttttttcaaaaattgacacgtagatgtggcaagtgtgtcaaatgaagaaactacttgaatagaagaaatagattgtacagtgtcagcaattagaaaatatttttaaaattaaaatgtgaaaagagttaaaatggagatgagatatcaggcaggtaaaaagagggatagtcttcacaggggtatcaggaaaagagtcagcatatgaaagtttaaccccagccaagtacatgaattatccttttcccaaaagtgaaagaaaagaaaaaaaagaggacacaagagtagcatctgacacatgaacaaaatgataataacatctaaggaattctgctccagtagcctaacctacattttagaaattatcactcatttaataaaaccactaattaatattcaactgatattattcattgacaaagcacctcctcctattagagcacaggaccctgttgcttacttggattctggtcttgaagaaatactcttccttccctccacagctcttttccttgctccagctgcaaaattatataggatttgcttatctggtaccctgttagtggaaagaatacatgtgttttgagttcactgtcaataaatgtgcattatcaccaagtgtaatgcaggctatcaaggaagaataaaaacagtgaaggtcagctcaggccacaagacctagaacacagaaaactccccaggatttttctgacccaatatgagactacaaaataaatccaaaccaaaggtccatcaggaaaaggaaattcaaaacagtcaggacctatgaatgctgagtccatgcctaagttccaagacgcaatgcataatacacaatcttttcagaaagagagtaattatatctctgcacagtgtgtttactattattctcacgcacaacaaaaaaaaacattcgatttacaaaaataattggtgttctatatggaaaagatattgctattgttttccctaattggtctcagcctaagcatagactaaagcagaagagttatttagaaaatatttaatttaatacactgaaaacattcattaagttcccaggtctgttatgagtattagagactgagtaccaaagaaaccatgaaatccttgtcaagactacattctaattgagtgacaaactaaataaaataaaataaaaagaaagatatttatttcagatagatttagagagttcaaacctttttcagatgagatctgtgagagaatcagagaagagattagagtgagatatggggaagctgttttaacacttattgaatgaatgagtgaatgtgtctctacatatgtacatgaatgttcagggactcaccgagggacaccaggtgactgatattttccagcatcacatctctgtacagctttctcttggatgtgtccatcatggcccactcttcctgggtgaagtcaatagctacatcttcaaaagtcagtttcttctaaaacatcacagacattttagtttagacagagaaattcctttcaatgtccggaagaggaaggctgagatgacatagctagcagctgggtatgcagaatactcagtgttttgggttccagccagttcattctcagtactaagctggtatctgcctttcagattcactcacagagatatacccactctgaatccattaaagtttactataaagaaatatcacatgaggtgtggcataatataacccagatatttttcagtaatgtgttaatcacctctacataactgattataaaattttcacttgaacattcataaataaaatgaaatttaccatgaatttcaagtaaattacagatttgtcacaaggcaaataaccatgatttactacttcttaagcatgactctgatgaaataaattatttctccagatgaaccacaggtttctcaccaatcaaatggttaaaagacctatgatgtgttttgaataatctaatgaactaatagaaaacgtgtttcctatctagcaaatatttattaaatataagtcattggtcccttattcattaaaaagttagaaagtaatgacccagactccagcattcttcagaactgaacaagctttatgcagaatataggattcaattcatatatatagtctctctaatgttatataattcaggtattcatgacaaggcttaaagacagtctagcagcacaagacaagaccgctgaggctgctatactgaggaaatcttagtccgatgattcctgtgatatgaagctttctgttctcaactttctctcggcaatccaaacatcagttatcatcgtttctcttttaaatttaccttctcactacacttgttcaaagatttaaaaagcctcttcattgttttttttctaaccagcccttataaagcatttccacagaaccctaaattgtactctatctactatattccttcttctgagtgtgcaaccataattaaataattatatttcttatatgttacttttacttaccagaaggcaaaaaggttaattaccaaaaggtaaagtgaatggggataagaataataatgacttctttagttgtcctttcacaaagtttttaaaagctcaaatacattttatcaaactcttcttttccctcaacactgcacagctcttgtccaagtcctatcacactggatttattgaactcagctgctagaacatcagactcattgttgggctgtgatgttctgctcttcactcatctctatcgcctgcattaatcacaatcctaagtctatttcaggcaacagtatagttaatgggtcaattatttccctatgagattataggatggatagaagaaaaagaaatatataaatgaaacctctcatatctttttttgtaaatagccttaataggggctggaataaagtagtgtaatattagaaattatattgataatttcggagtctttgacacacgatacccaacctagagtcctgagaaaacttaatggggggccagatacctgaaagcctcctgattgcatttggaacacccaggcagggtggattttacatcataaaaacaaacaaacaaaaaaagaataaaaatgaaacacccatgcaaattggagaaaactgcccatttgccagcaatatgggtataatttcagtagaaagaggcatcccctactcactagtgaatgcattgtcaggaactcagtttctctctgtcttcctctggatttccacttgcagacactttaggcactaagaaaagctgaggttggagaaagaacatgtgagacaccagtcttgtgcacaattttcagatcaatctgtgatgaaaagccagactttcactgaagtgtgacaccagctgcaccacagcctaaccaacagacacaaacatgcagaggcctctcctcttttcccgtggtcaaaattaagaagcctatgactatggttgctaataaagaaggaacacagatatcttgtgaatgagaacatcaaaagcacggagttttgtatgttaattggcacaagtccagatattcaattccctcactgattttaaaacacagggatccctgactccatccacatgtggaatatgatttccacctatagataaacactgggatttctcagattttattatcctagctttatgccctagcaacgtttctccaacacccaccacagccttctgaagccttactccacttttattttcactcaactctgacttttgtatttccccttggaacttggaaataatcaagtaagaatctgttttagggtggagtgtggtggctcacgcctgtaatcccagcactttgggaggccaaggcacgtggatcacctgaggtcaagtgttcgagactagcctggccaacatggtgaaaccccgtctgtagtaaaaatacaaaaattaactgggtatggtggtgcttgcctgtaatcccagctactcaggaggctgaaacaggagaatctcttgaacccaggaggcagagattacagtgagccgagatcccaccactgcactccagcgagggtgacagagcgagactctgtctcaaaaaaaaaaatctgttttaggatggggataatcaattgagggatttatttcacttagagggtcaacactcccatcctgctaatatagcccttaaaatctcctgcatcagaaattagcaggagtaccccgagtcatggtgtttctctcctgtgtatacagtcacaatcctctaggatgctcagaaaatacaaaatgacttaggagagggagaaatttagcagctcaatctgatattttactaacgtggtatctaaaattcttgcaatcatggtttatattagtctttgttagttgcaatatctctgattatcatgatacatatttgctgagaaataccgatgtccatgtatacattcgtacatagatatgtagatatataggtgcatatgtttatatgaatgtatgtgtttgagacagggggaaacatgcatgtattatttccctgctaaaaatataaaaataattaaatatattttatgtacaaatgataattatgtgtcataaacaaaaaatttactgacccatttgtacatgaagtccaggaaaaataaaaagagtaactttgtattaattgtgacattgtgcttacagatgtacatatatttccttatttaaccctcataataaccctgctgattacagtttatttaccaatttaataaatgatcaacagagtttgaaaaatatgacaaaattacaaaattagaaaatgacccagcaatacttttaattatattctgcgtgtcgctgcctcttcttgctttttgacaaaattactcccctaaccaacgttctctatgattctggggactccagtatttagaccccaggtcccaaacatcattgtgtctatttttactgccacatttaatgcacatttacagacttcaacaagcacttttcaatatcaacttttttcttattccttggactattttctacatctgttcatcaagattccagtaacatatgactccatctgcctgtcccttccatgaatgtacctgacagtacatgtattatgtagtctataattcaagcagaacagctattccttcaaaaaaataagatattagagaatgcctacaaagcttcagtgaaaccagctgtaacccttaatattattaccaagtaaactcttcctcgaatatcaaaataagatttgggctttagagaatatttgtgtgtaattataacccaaacatgaatgaaaagtcatttaactggtcatatacagactgtgccagggacaaagaaaggacaaatattataagaaagttaaagcatacttatttcataaaggactcttgtgtggaatctataaaaactatttcaagatgtagagattaaatatatttaaaaacacatacatacacaagcaatctttaggagaaacttaaaaacttatgttatgggtctaaaattttcattaattcgtggaaaaaaatgtattgacaaacttttcaccagagcagaaataacaacttatgtatttggtgacttcaagatgagagcctgcacagcttagtatctccctccagatgtctctctctattttttttttttttttttttttggcggagtatcactcttgttgcccaggctggagtgcagtggcgcgatctcggctcaccgcaacctccacctcccgggttcaagcaattctccagcctcagcctcctgagtagctgggatgacaggcttgcgccatcgtgctcggctaattttgtactagacgtggtttctccattttggtcgcgctggtctaaaactcctgacctcaggtgatccgccagcctccgcctctcaaagtattgggattacaggcgtgagccaccgtgcccggcccagatctcttaaaaagtcaagaggaaggaaccattctgcatcctcaatattaccttaatattttaaggacacccgtaaaaattaagaggccgacttgtgacttcctagccctttcacggctatttagacacaacttagtgaagtattaggaatgcattattaggtcttaagttcctggacaacaaaaccatgttctccaacagatcttcagtaaaaataactgatgtctatattgttttgcctgtcctttcccttcctttaattcagaactgcagtctcgaaaagtgctattatttagtagattctctcacttctcaacaccagtgctatacaatgttgaatgacatctcaggtgctagggaaacagcagctgacattctagcaatgaacaaatagaaaagcaaagatcaccacagagtaaaagagaatagatttttttaaagtatgaaaccaaaacgaatatatatcagattacactataaatggaaaatcctattatcttgacgggattgcaagtcagattacactataaatggaaaatcctattatcttgacaggattgcaagcctctcatggcttccaacatccaatatattcaaagcagttcaggaatggtgaaagtggaatggaatttaaaattattctaaggttttatgtgtgaaagcaccatgccctgaaacaaaacatttatttttaaagtgcataatgaacactgcatacaaagtttgtgtaacaggagagaggaaaaatctcacattttaaaaaaaggaatatgcaacatatttagatacaataaaataaaattaaattaaaatacagcaatagaagacagaatctaacatctgaaaatcaagggagaaatctattttaaagaaacttggcgcaatttttaaagtacatgatgaaaaataataatacctgagtatagtacgtaaaagtaccaatacaataaagctaaaacaatatccatggacaaattatttgctgtacgttatttttaaaaaataatctaagtacttacctcaataaggtaaatgaatgaaatttaaacattgcttgagaaaatctgagaaaggagatgaatatagagaagcagaatataatttaactataaaccacacaaatagaatttaaaaataagtggtagccaacatgcccaacacgattttctgtgatgaaagaaattctctatatctgcattgtccaatgcagtaactaccacacatatgtagttacagaatttctagattggccacgactttggctattactactaaggatatgccatttagttatttaattataatttatttacagtttatagtcacatgtgactagtagttactattttggccaatacagatctagaatcttggaggaggcagttaaaataatgagatatggtcaaaacaaaaatggaaaaggcacacaaatagtgaacacagaatatgagaatgtgaagtaacaattcacacaataaaatgtaataatgagatgctgccttgatgggacaaatgtctaatgatatacaaggcttgtcttgttacaggtagaagagcatgagcagggcaggagagggctcttcccctacccactagaaatgtcaggtgatggcctgtcaattatcacatttcctctctaaaaatgataattaggcagcaccagagagaggccgtttcctgatggtctacacctgttaacatcaaaaatgtgagttaaatgcagaccccaggaagaagcaacttcttgggcgtgcatgttaagagacaaaaatggcaaagcataatcttccgggggcacgctccaccggaaaaggaaagaaagcttcagatggacatgcatataactccctaaacacaacgtgcatgctcaatttcaaagggtaaggaaagcactgtgcatgccggaaactctccctaaaggacgaatcacgggaaagaggaaaacccaacgcaggatcaaggttaaaggctcttctcttttctttcttggaccttcaggcatctgctcgggtctcttccaagagaattttcctctccttcctgttctaaagcctttttaaataaacttccactcctgctctgaaacttaccgctcagtctctttttccactgtatgcccttcggtcgaattctttcttctaggaggcaaggactgaagttgcttatggacccatgcagctatgctgccagtaactggaatctcttctactggtaacagtatcattgtaagggaatgaggccagttcacatctcagtgcttggagaactcaccaaaaataaaaagttggaggatgcagtgaacttatctaccttccaaggcaagtcccacaagcaagcagcaagactctttccccaaggtcttaaagtcttcagatgctccttctctgggaaaatgcatcctctgattggcttccccttatatatgaaaaaaaaattaataaaccgaatcaccactacattccaagagacatgccctgattgcacagacactgaatctaatcaaaaacttcattctggagacactccctgttcaatctgattggatttttgagactactactaaaaaccctcacataaagttggaaaccaaagagttaaggctattttgaaggaaaaatatgaacattaattcctttttttaatcataagtacttttgagtgtattatatgtactagaaagcattcgcagtcaagggatacaacaagaaaccagacaaactagagtcttctggagactctatattctaaaattctttggaggtaaactggacttgaaaacaaatggaaggcgaatagatataaaaagtttcaatgttcatgatgatgtaaaaaaataaaatacattgcagaaatgaagtcaggaagtattataggggtcatgtagtacttgtaagaccactggtattgtctgaaattcaagcaggctgcagaaatttgggtaactaaaaggaaagcagatgctaatagaagaaaatgaagaaagggcctcaaagacattttagagaccttggctggtggcagcccctctcctcaaaggcctggaggcctaggagggaagaatcattttgtgagctgggcccagtgcaagcacaggacagtgctcacagcaatctaggtctcagccactccagctccagccatggctaaaagggccccagacattgtttgggccaccgctttagagggtgcaagccacaagccttggcaatttccatgaggtattaaacctgcaggtgcacaaggtacaggagtacactgctgataaaggtatacctgagactgggcaatttacaaaagaaagaggtttaattggacttacagttccacatggctggggggaggcagaaggcaaaaggcatgtcttacatcacagcaggcaagtgagagaatgacagccaagcaaaactggtttccccttatcaaaccatcacaactcgtgagacttattcactaccacgagaacagcatgggagaaactgcccccatgattcagttatcgccactgggtcaccccacaacatgtgggaattatgggagtaaaatttgaggtgagatttgggtggggacacagagccaaaccatatcagaagcctttgcctggatttctaaagatgtatgggaaagcctgtatgtccaatagaagtctgctggggtggagacttcatggcaaatgtctactacagcagtgcagagggaaaatgtggcgttggaacccccacagagtccacactggggcactgcctagtggagctctgagaagacagccaccatcctccagacccgagaatggtagatccactgtcagcttgcaccctgagcctggaaaagctgcaggcactcaacactggcccttgacagcagccatggggactgacccttgtatccaaaagaaaataaattgttctaccataaagatgtgtgcactcatatatttattatagcattatttgcaatagcaaagacatggaatcaacctagatgcccatcaatgttacagtggatagagaaaatacagtatatgtacaccatggaatactacacaaccataaaaaatttatgtcctttgcaccaacatggatgcagctggaggccattattctaaaataatgcaggaagagaaaaccaaataccatatgttcttagttataagtgagaacaaagcattggttacacatggacgtaaagatcagaacaacagatactgggaactactagagggggaagggaaggtggggacaaaggcctgaaaaactatctattgggtattatgttttctatctgggttacaagatcattcatactcctcagcatcacacaatgtgccagtgtaaaaacctgcacatacatctcctgaatctaaaataaaagttgaatttttttttaaaatgggcaaagatctggctaacaccgtgaaaccctgtctccactggaaaaaaaaaaatacaaaaaattagctgggcatggtgccgggtgcctgtagtcccagctacttgggaggctgaggcaggagaatgacgtgaacctaggaggcggagcttgcagcaagccgagatcacgccactgcactccagcctgtgtgacacaccgagactccatctcaaaaaaaaaaaaatatgcaaagatctgagtagacatttcccagaagaacagatacaaatggccaacaaatatatgaaaaaaattcttaccatctctaatcatcagggggatgtaaataaaaaccaccatgaaatatcacctgatagaatagctattatcaaaaagatgtataacaagtattagtgaggttgtggagaaaagataacccttgtatacttgtggtggaaatacaaattactatgtccatttcagataacagtatgaaggtttctcaaaaattttttaaataaaactacctgctgatgaggctgctgagatataagaacacttttacactgttggtgggaatgtaaattagttcaactattgcggaagacagtatggtgattcctcaaagacctacaaccagaaataccgcttgacccagcaatcccattactgggtatatacccaaaggaatataaatcattctattataaagatacatgcacacatatgttcattgcagcactattcacaacagcaaagacatggaatcaacccgaatgtccatcagtgacagactggataaagaaaatgtggtatgtaaacaccatggaatactatgcagccataaaaaggaatgagatcatgttctttgcaggaacatgaatggagctggaagccattattctcagcaaactaacccacgaacagaaaaccaagcactgcacgttctaacttacaagtgggagcagaacggtgagaacacatggatattaggaggggaacaacacacactggggcctgttgggaggcaggtggagggagagtatcaggataaatggctaatacatatatgcaatggaatattgttcagtgttacataataacgaaaccctgtcatttgtgacaacatggatggacttggagggcattaggttatatgaaataggccaaccacagaatgacaattactatatgatttcacttgtatttgaaatctaaaatcgacaaactcacaaaagcagagagtagaatggtggttgccaggggccgtggtgctggggaaatgggtagatgtggttagagcacaaagtttcagatataccacgtaagtaagttctggaggtctcgtttacagcatagtgcttacagctaagaatactgtattacatacttaaaatttgctaaaagggtagattttgtattcttaccaatatttcttaccaaaaaaataataataataaaggggaggggacttagggaggtgaaggatatggttataatcttgatggtagtgatgtgttcatggtgtatacttatccccaagctcactgagatgtacaccttaaatatgtacagctttttaaatgtaatcatagctcaacaaagtcggttaaaataaaacaagagggggttggttaaaaaacttaaaaggaggggtagatgttcccttgtttttttctcttggcttttttcctacctgctgcctggaattcaaaaatgataggtggggatttagcagccaaactagagcctcttttacactatagcagaacagagtgctggaaggggcctgcatccctaatgaatttggcaggtatctgtactagccatggtaggtagaactatagatttaagtgagggagaaacaaacttctgccttgtttaagctactttgttcagacattaattttatatacatatagagaacatatgctcctttatgagtaggaaaaatgtttatgccatatggtccatgatgggtgttcaacaatgtaggatgaggctgattatgatgacaatggtgacaaatagcatgaaataataagcaatgaaaataaggtggcctcatagttgtgtatggttactttatttaaagattctgctgctaatatcattcaatgtatttgtatgctggtgggagttttgttagatgtagactaagaaagtttacattatttaatgaaaaatacttgaccaatttaaaaaaaaataaaaatatcatgagatggaactaagcatctgtattgcaaagtaactctcccagttgattttctgcatagtaatgattgagaatcccctgatctagatccaatagatctcgacctttataggtgctatcaaggaagcacctaaggaagacaattttcctgactatatccatacctccagttagtaatagatctagagatctagaacccaaatccaaacctcctgcctccacgtgcggtggtctttcgctgttgttttgttccacttggtgaagaggatttgagaataaatagccacatgattcaactccctcctcagttctgaggaatatagccttgtcctagcaagcaagaagttcatacagtagtggatgaggcaaatatacattcactaatctaacatacaaggcagtaagtactgtaacataaacaaagcactttggagtttcagaccaggagcaagtggggtgattaattcttagcagggctagtaaagtctgggaagtgttcactaacaaaatgtctggtcattaatgaaaccaactggtttctcaacacagtctaatttattgtaacaatataaatggttgtttgttcataaactttcatcttttgccaaaatgtagcttatgtccccatttaacaaggttttctggccaaaactgtgcacccacatcattctaatgaactggctgtccaataaaaaaaaaggattctcagtcttcccataaaagcaattttgcgtgcatagaacacctctatctatgaatatccctaaggaggtacagaaagactcttattatccaaacagagacattccactgctgctagagagccacagacggaagttttctctgcctcctggaaatgaagccaaacttttttctttcttcagccatgaggattgctgtcctcttcttcaccattttcttctttatgagccaagttctaccaggtaacaaaataaacttggtaagagtagagtgcctaacaccttacagggattcagtactcaaagagaaatcaccatcacctatgaccagaaaagggggtctcataggaaacctggaagactcattggctgagaggcctgcagccatctaattcgttaattctccatagcaacccagttaaatgaagtcaatggtgtttcaagtctttgaaaccctcttattccatctccaaattaggcaagtttactagcagttactagacctcaaaaattaaaaatcaggcattattctactaaatttttgtctccaaagctcctctttcggcaaaagtcagttatcctaagaactggcataagagctatgccaaagctgtggtaggctcagacagaagggattggtggaagaagtctctttgaaaatattactataatctaagaaatctttaacctattgctccccgatactgttggtccctggagcttgacttttccccttaaggctccatctccatccctggctgtccctcttccttctcagcatctagtcttgtaatgtagaatttaaacacaggaaccagggatgatcccacaccagagcatagcctactgcattcagcatgcgaacattaatcacaggtataaggccccttgcacagacatgctttggagaagtgtgtataggacttcttggattggcccaaggtggttaccagatacccaaagtagattcaaaaattttctggaactcctgaacatgtgtattcaaggacgaataagcaacttattgcctctatttttgctgttttatagagaaaaaaattaaggccctggaaactgaactgtttttcccaacagtggggtaaatgtcagagtcaacactttgttttaatatcctggctttccctatacatcccaccctagagttctgttgtgctgttcctttgtattactttctaaagcctgaaaaaaggtgataccatatccaattatattaactcggtagcacacaacatcggggactgacataagattattatccttgtggcattactgaattcctatctcactagtacttgttaaatagtcatcctggctaaatacatgggtttgatttttttaatcagttaaaaatattttaaaatatgtgtcttacatatataaccccagaaaatcaatgcttttaatcaaggtttaaaaattccaaatttggataaacacattttgttttgttttgttttcactgttactcaatcaaaatagaagcaactaattggatagaacagcacaggcagaagcatgactcacagtcaaaaatgggatgcaacaagcctggagaagaaaacacaggatggtgctaaagaatgcaccctaatgaaaggtggcatctcctctggatgtccttaggtagacattgaagcagaactgccaactttttgtagaaggctagagaggagaggaggacacagagagagggcaagagtggaaaacagaatgaggctcagaataccaagccttagtgctgtccctatcatctgcttcactcgatcactgggtaatcttgggcaagtttcttcctttccatcagcttatttcctcaactttaaggtaggtgactagacaagacagcctatgttcattgtaactctatcttttgttcctaaagcaaatggccggaaaagacatagtgtccacaatatgcaatacacaaggtttacaagaaagaacaaatgaaaacgaaagatttttaaaatccctaatgttacttgaattcttacaaatgaacaatggtacatcataattttaaaaagtcttttgtaatttcaatttttaaaaataacttcaacctttattttagattcagggagtgcatgtgcagatttgttacatgggtatattgtgtgatattgaggtttggggtatgaataactctgtcacgcaggtagggtgtgcccaaagagtagcttttcagactttactccctctccctcccctcctggtaagacccaatctctcttgttcccatttttatgtccatgtgcactcattgctcggctcccccttataactgagaatatgtggtatttgtcttcctgttcttgagctaatttgcttagaataaagtcctccagctgcacccatgttgctgaaaaggacacaattttgttctttttatggatgcatagtattccgtgacatatatgtactacattttctttattcaatccactgttgatgaacacctagtttgattccatacctttgctactgtgaataccactgtgatgaacatacagatttaggtctttttacaagactgatttattttcctttggatatacacccagtagtgagattactgggtcaaatgttagttctgtattaagtttctcgaaaagtggtttgaaaatataatgctcaatagaatcaggtatagtaaaatagtacacatgattcaaagacctctgaaccgagagtaacaacaaatttctgcacaaacatattgcaagttagaaaatagctgtattttaatcaattattccacaatcatttactgaatagctattataagccaagactttaatcagattctggaatatacatacagaggagaataagatactattcctgccctcaagaaattcattatcaagaattgaggtcagatgggaaaacaccacccatagtagaatgcaagaagtactaccacagagggatgttcaagagtgatttatcacatatcacaagacaggtcagtggttcatcctctacactatactaatctcttatgactcttccagctgcaaagggccaattttagcacaaggccagtgggcttgggtactactatatgtagtagctgactacttacagataaaaggaagagatggaaagctcagggatcaaaaaactcagatttcagcttgtttctaccaagtggtcaacatttacaattaccattgtcttcagaaaagcatgacctttatttcccaatttgcattacagatataaatatgatgttgcatatatttggtcttcacatcaatccactaactgctttgtgaccattgaaaagttaaatggaatctaatacatttggatttcaggtcaattaaataggcatttattgaatgtttattaaaatcgctgtactgattgaaagctattctagaattggcttttgtgttccagaatagaaaaaaaaaagtgctggtttttatacctctcttactgccaagaagttatcatggaaaaggtgctctgtgttacatacaaagactgctcagaattaaaacacttttcaaactcagtacctcagagtgtgtggcctatccccagagcggtgatatcttaggacataaatgaaatactattcaatgttttcaacaagtatagtttttgagcctttaagaagaccttgaatgtttcactcttaatatatgcaatggtttctagagaaaaattgcaacctcaaagaccagtgccagagatatgagtagtgagtgaagtctcagggtgtaacaagtaatggcacagatatatttatgtattaaacacataggaatattgttcccttccacaggaaaaatatcctctctaacaattgaagtatattatcttttaggtctatatttcagttctacttttgaaagatacatctattataatctatcatatagagagagtgtgtgtgtgtgtgtaggaataaaaacagctgatccaaaagagattttcttctctttcactccaggaaaatccatagtacaggacattatattttcttaaaaggctgacatctcccatcagtgttagaagacaataaggaagaaataaactgaaacttgtatgctctagaacttgtaaagggaagcaggctactcacctccagccttttgtcatgtaggtgcacccaatattctcagatttttcaagaacaccaaaaaatccaaatttttgtgtggcagcagatttttaagtgtttaagaaatcaaataacacacacacacacacacacacacacacagacacacacacaaatccacacaagattattttcaggcactgccccctacgtccatgtaattcaatacaaagtaaagaaagactgatgaatggttacaataaccccttctgcatgtagccaagggcaaattcaaggagatctgtgaacgtccaaatggctcctgtcgggacttttgcctcgaaacagaaatccatgtagggagatgtttaaatagccgaccctgctgcctgcctctggggcatcaaccaagaattgagagcactacacccaaaaaggactgaagcctgttgttttctggaggttttaggttctcttttttctctctccctctccctgtctccctgtctcccgttccctctctccatttttctcacagggatttttattgaatcctcaaaaaagaataaaccaaaaccaaccagcacaaaacctcttttaaaagtttatattactggctgggtgcggtgactcatgcctgtaatcctagcactttgggaggccaaggtgggtggatcatgaggtcaggagatcaagaccattctggccaacatggtgaaaccctgtctcttttaaaaatacaaaaatttagccaggcatggtggcgggcacctgtaatcccagctacgcaggaggctgaagcaggagaatcgtttgaacccatgaggtggaggctgcagtgagccgagatcccaacactgcactccagcctgggtgacagagtaagacactgtctcaaaaaaaaaaaaaaaaaaaaaaaaagtttatattacatgttatgacttgattactgtttggtttccagtatccttctatcccatctagatgagctcttagttgaaaatgacatacagcagggtgggggaactttcaatcatacccattgcttttgtctagcactgtaacccttcaccctgcatgtgggaagaccactccccttttttactaggaaaatgcgccatcctattccatgcagccttgcgggggtctgtctctccctgataaaggtgcagcacatgggaaaattgcacaatcacgtcaaccagacttcaccagaaatctaaattataaaaagagttgcactcagattaaaggcaattttttcagcacccttttcggaggcaattccctgggtctgtacatgtatgcctggccaagattcagggaattcctttgcttcccagctttcactgggcataatcattcagcattttcttccatcttttaaaatactgtattggcttcctacggctcctataacaaattacaacaaacttagtggcttaaagcaacacaaatgcattatctgacagttctataggctgcaggtttcagatggatctcagtgggccaacatcaaggtgtcagcagggctgagctttcttctggaagctctgcagttttcttcctgcacctttatcccagcaatggcaggttactcctgggcaccatagcttccttcatacattttcaaagccagcaacggagcgttgagtcctcacattccatcattctgaattcatcttctccccactcttccattttttaggactcatgattacattgggcccacctggataatctaagataatctccctattttaaggtcaggtgattaacagccttaatttcacaggaaacctcaattcccctttgcttacacggtggcacattcacaggacccaggagttaggatgtggatagctttggcgggagacagaggggacattattctgcctacaacagccactgagtgcttttaccacctgtcacaattttcctccatttagacacaactttagtggctttgtgtgaagagattctcattcatagagttttcttttttgtgtaaagtagtggggggcctccccttggtcattgaaagagtatagaatcaagatatttaaaagtatgttagctggattttatttttcactatgcctgatttggccaagaaacaatgttaagttatgtcacatggactactcgaaatctcaaaaagttcaaaacattgggttcaaaatctcggagattgagatatattccaaccaactcaaccctatggaagtgccaagttttcctcagtgcactcttgaaactgcatcaccaactgtccctttaatatatttttgcactatataacatttatttcttagaaaagaagcagtttggacacgtatattaaagccgtcacatagaatattatcctctcattgctaggaggcggtcttcaagatggctgactagaggtaccaggcactgtgtcctcccaaagaaagaccaagacagcaagtagataatcataccttgaagagggcatgaaagagggcactagaattcagcagcaaagtgatgaggaatctctgaggtatggaaggaaggaaaatgaagcagctgcccagccagaatcagcttaaagccaggacaggctctccagtgtggtgaaaaggtaaaaaagagagccccagtggtccatattcccactgtggacactgcaatcctagccaagggacagtctctcagccctcgcaggccctgagactgctatagggagctgcctggagtctaggtgatggtcattgtcccagagaaggagttggcactggatcgtctgcacctgcccccagacacaggcagctgtggcacaatgccaatttgagagcccagcccccaaaagactacatcctgccctggggcccaacagcccctgcatctccacatctctggaccctcagtgacattccctcatgtccatccagagtcctgcagagtcacaataccagctgaactcaccagtgtagcttggtccccatcactctagcctacacagtgtcctacactccagggaactggcagtgccattcactagggaggctgcccccagaacaaagggagctgaagcaggcactcttctcaagtggagagtcaccttcccaggaccactgacactgacagcaatcctggcccccaggagcagggccactgcacacctgcaggcatcctcaggggacctggggactcacctgcctgagcactattccagggccagagcacaggcccatcccacccattgctgtcactaccactacccaaggtcgttgtccaggaggctggggatcaacccacactgctgtctgtcattggcacctgtgcatgccttcttgtgaactgagtatgagcccacccagcctggtggtgcctgtgcacattgtctgggagcctgggaattaatccaccatgcctatcaccatcaagtacctgtgtgtctcctgagagcttaaggataggacttcccagcctgccatcacagctgtcaccagtgcccacatatttgcaccaggtgaaagcctgaggactactctgtccatcatgttgccatgactgttggtgtctgcacatgccatctggggtcacgagagttgacctgctatgactactgcaattgctgatgctacacatgcctcccagggtcttgagggcatgcctatctaccgagctcaccactgtcactgctggcacttgagaaagccacctgactcacgcctgtaatcctagcactttggaaggctgaggggggcagatcacccgaggtcgggagttcaagaccagcctgaccaacatggagaaactccatctctactaaagacaaaattagctgggcatggaggcgcatgcctgtaatcccagctactctggaggctgaggcaggagaattgcttgagcccaggaggcagagttgcagtgagttgaaattgtgccactgcactgcagcctggcctacagagctagactctgtctcaaaccaccaccaaaaaaaaaaaaaaaaaaaaaaaaaaacacaacacatctttgccgtgatgtctggtaaacagaaagtggtcagcattatttgttattagtattagtgttgtcgttgccattgctttgattcacatggaaatggtttgtaagctgtgatgcctactattaatgttatctatcacaattgttagttatgtctggtatctattgcaacaactagatgaatgtaatcttgggaaaaaattttaaatttctttaagcttctctctcctgatttgtaaaatgaaatttgttgtacatgctgtgtttttctcagctatgcagctgttcagttattccatatttcagtgcttccttggctgatcaatcaatttggcctacgtcagctccaagggcatccacttcatcatcctccaggtggacttgtagcttacctgaggctgtttgtatcagacatccaagaaggagaaagagaaggaacagcagtgtcatgatgggaaatgagtggtcaggattatacgatgaccttacagcctgaaggtggctctttcttcagtgtacatcaattgaggaggacaagtgatctgggaatgagtttgaattcagctgggaaactaacacaggaatagaaaaccaaatattgcacattctcacttataaataagagctaagcattgagcagacatggacataaatatggtaattatagacactgtgaactactagagggtggagggaggagttgggttaaaaaactacctatctggtactatgttcagtaccagggtaatgagatccatactccaaaccaccacataataccatattcccatgtaacaaatctgcgcatgtacctactgtatctaaaataagttgaaattttaaaaaaatgaacatacatagagtaaatggatcttttttgaaataattttgggtaactaatacttaaatccagaagcagcagtttattgcacttttgtttcattttagccaatttctacatgtatgtggctaagcacacaagggcgtgatacaaaagtggcaaaacagatctgctgagctacctgcaaatgcctttcagaaataaaataaagcatcctttagtggtgatgcttcttctcaagagcaaatgactccactcaaagtaaatcactgcaaaatttaaaaagaagaagaacaacaacaacgacaacaattcatctagagagaaaaagcttgcattcctgattcaaatgttcaaattatggcatggctgtaacctgagaatgttccatctatggactcatgattacagatccaagtctcctcctattcaaatagaaagtcttcacaataattttgcattttctggtggattttcatttctgcttatggctctgaggtttggtgccttttttccccagaataaattattataaaatagtgatattgaggattcatccatttattcatttatcctcattcatttcatgtctctgcatctatcaactttccttttggaaatataaagaaaaccaccctttaaacattttttatttcttccattctataaaaaagtttatttttaatgccagaccatgtaagggcagctattttaaaattgcgttttgattaaaattgcattttgaattcatgcaagattactttctgtcaactgcctctttccacacatctatggattaaattaaccaacatttaataccactgacattaccttatttcaagatctgaaagtgctacatgaatcattaaggagaggttaaattctctctcttcttttcaaatttcagtagtttttggggtacagatagttttttgttacatggatgaattacatagtggtgaattctgagattttagtacacctgtcacctgagtagagtacattgtacctaataggtagttttgtattcctagccctgcggccttctgagtctctaaaatccatcatatcactctgtatgcctttttgaactcataccctagctcccacttataaatgagagcacttggttttttggaaaaccacccattttagaagctaaaaaaggagaagaaattctgtaaatggaaattacattttttccttggttgagttcaatgtttgatttttttttttttttttttttgctacctggttaaaagcgataattctaggcaggctcttaccatgtcaaacttctgcatagattacaactaggtgacacattaggggccaaagagtttcttaatcatgtagtgcaatgcatttttatggtaaaggaattaaacagcagaaagtatacacggtaaaacactgaaattcctccttctctctttcccctccacatctgtgttgctttatattgtttctacatctctcttcttctctacactgtgagcttctaaagtaacaggcactgtctgattaccttacttcctcagcccctgagaagtacctagcagagacgaggtactcacgtatttgtttaaacaaatgaaacttgaatgaaagaatcaatacatgaatgaataaattgacagagggaggaaggaggtaaggaagtgctgtggcctgaatgtttgaatatttgtgtctccccattcatctgttgaaatgccaacccccaaagtggtgatgatattacaaggtgcgggctttgaggaggtgattaagtcgtggagctgaagcccttgtgatgggattgctgcccttataaaagaggcctgaaggagctcgtttgtacctttcaccacataacaacacagagaaggaagcgagctctctccagacacctatgccggtgtcttgatcttggacttccaacctcgagaactgtgagaagtaaacttctgctctttataagccaccctgtttatattactttttaatagcatcccaaatggactaaggcaggaaggaaggaagaaaagaaggaaggaaggcagggaggaaactcagggatgcatacctttcgacctctctaacagtggtcaccctacattaataatcagtatgtgttgagaagccaaaaggtagattgttgatgagatgtagacatcagagaaatcagccaagctctgatgtaagctgtggtctttgcaaaaatagagacaattttttttttgtacctaagaataaaagagctctaaagtcagataaccctggtttcaaaacttttgctctgccattcatcaactgagtgatcttgtgcaaataattcaacctttcaaagctccagtgtctcctgtttatttggtgatggctatagtgtcaacctcctactgtttgtctcaggaaaaaaaaaaatcttaggaggagtcaattgctacccaatacctatccacacagagttgtgttttaactaggatcaccacaagagtttcaaccccatcaaaaagtgggcaaaggatgtgaacagacatttctcaaaaaaagacatttatgcagccaacaaacatgaaaaaaagctcatcatcactggtcattagagaaatgcaaatgaacctaacctgtaagaggaacttttaagtcaacttctggatacctgaaatcacacaagatactactttcctccataaagcctggaatgtctcaaaaaaatccctaaaatttaaaacttaataaggacaactttgccttttagggcccatggaattagaggctggtagggaaactttggccattttgggtgtgggagaaagatggtcgtagataaggcctaaaattgtaggaacacactgaatttcacttattaaatgttagcataacttaagtttacataatttaataaaataatatagaaactcctctgtcactccagtaagaatgaacattcttgaacacctatcacgtaccatgagtcttgaaagtggtatcttagttgacataacttttatatgagatagatattttctctgagcaagtcaatgcaggttatacaactagtgattgagctgggatttgaactatccacaatcaaaacttttgcttattttacagtctttcttgctaaaaaagaaagataatattttttgaataaaggaacacatctctagtgagataaactagttctgtgtgtttgacagcaatagagcttgaggttcagagaatgaacagggtcgtgcataaaaggttgtctgaattgcacttccctaacaaagggggaaagtctgcatcaggtgggtcatggtgggccaagtgggtaaaggtcagtgctccttaatcacttcccaaatgttccgcttcttaatactattgcattggggattagatttcagcatgaattttgggggagagacacaaacactcataccacagcaaataatgatggtgataatactactgataataataataataataataccactagaaagtaaagtggaggctgaaatctgttgtctacattcctgtctcctacacttacaccctgaaagcaagcctctttattgcctcccaccccttatttaaaaccagttggccctactggaaacccaccttgcagttggttcctccaccctccacaggctgtgtgctgtatgtcccttgggacaaggacacctgaaagcagctccagtgaccacataattaggggtcatatcaatgggcagaggcagagcttagtgaggtcatgcagaaggcattgtgaccctattgacagaagtcaggtttgagtggcagtgagggaaagaagggtggtaggatgtggggactctgtagcacccctttcatagggtttccctgaaaagctgggcaaatgcaaaagatgagagctcttgtgtgtccaataagtgtttttcttttagttggtatagatgcagtagaggggaataagagatagattaggtgagagaaagaattgctggagtcctgatgcgatttggctctgtgtctccacccaaatctcatctctaattgtaatccccacatgtcaagggagggatctggtgggaggtgattagatcgaggaggcagtttctcccatgctgttcttgtaatagtgagtgagttctcatgaaatctgatggtttaaaaatggtgcttccctcttctctctctctcctgctgccatgtaagatgtgcctacttcctctttgccttctgccatgattgtaagtttcctcaggcctccccaaccctgcggaactgtgagtcaattaaacctatctttttttttttttaataaattactcagttctttatagcggtgtgaaatgggctaatacgagtcctgtctatgagtaagcaaggaaatgcgatctacgaccctttctctcttcttccctctttacccttcccacctttgttccctcctttcctctctccttccttccctcccttttctttattcctccctccctgctttcctccctctcctttccccctccctttccttcttcctttttccatcccttctgtcttttcttaccattctttctctctctctctctctttcagtgccctgtcttttttttttttttaacttctctttcaatacatgccgggacaaaataaaggaatagcgaagctaaagtcatctgaaagccaaagttgtgatggagaacagtgaagagaccacatggggcacttatggcaagggttcaccgtataaagtgccccaggcatatattatgagcttctctaggtgccccaaaactcttccatttaattataaaaggatatactcgtaaagagatagccagaatttctatccttgaaataaaattaatcattttacttccatttaaaatggcacttatcccttaaatataggcaccccagtcttgccaagaaaaagcgatgggatcatcacaggtaatttcagtctgttaggttgggccatgaaaacataaaactctgaaacctcctctaaagctatatgtaccttcaatgttaaagggaaggtgcttagttttcacaaactgttcaaatagtctatctggtctagagaaagaattagtaataaactacaatctaacctcaatttatgtcaaccctcttgtttctcagctccctcttatctggagcaggcaacaaggacaaaaatggcaaagtgaagagcaggtaaccgacattcatagctggtggctgaccagccaagtgacaagccaagattgctaccttcttaagagtctgacactttctacacaaatgcagattctaagaacgtacatttttgacctcaggtttttatggattatgatctttcacttctggaactcagatgagggttgaaggcattaaaggcagcctgatgttttgcaaggcagcaatttgctgttttttggggttttttttttttttttggtttttttttttttaagaatagcactttggaggtgtgtgattgattaataaagaattagaccttgaaccagaagaataaatctctgacagtacatatttactctttgcaaattctatggaggaagtgcttttggtgtaggaatatcctggagatatgaaatcatggaatggatacatatgtcttccaccctcacctaagactgaatctgttcacaataaattccaagctacagatctgaaataaatgggctattcatgtaatactgagctcagagtgccttctgagggaggaagagttatcatatgagccttgctcatttctaggaaaaaaacatagaaagttcagtaacttgttgcgagtttttcatcattttttctccattaaacaaatgtaggcttaggtcatttgtgttactaattttatgctcaattcatgatttgaaactaggatatagtcgaccctctgtgttgatctgaaaatactcaggaaaaaagaaatgtgtctggtctgaacatatacaggctttttttggtcattattccctaaacaatataagttaacacccatttacttagcatttacatcgatttaggatttacaggtaatctagagatgatgtaaagtacataggaggaaatgcaaaggttatatgacaatacccatgccattttacatcaaggacttcagcatctgaggaattttatatccacagaggacctgaaaccaatcccccccggataccaagcagcaactatatttgttaattactgctgaagtagtaaattgtcattaaccttagtgactttaaacaatgctaattaattatcttacagtttgggggaataaaatatccaaaatcaaggtgtcagcaagactgtgttccttcctagagtctctaagtgagaatctttgtttgcttttttgttttgttttgcattttcaagctttagaagctgcccaacttccttggcctgtggcttcttcatctcaaagccagcaatgcctgtcaagtcattctaacatcacatcatgaagacactgactgttctgtctctttccaaatttaatgatccttttgattacattggtctcgttcacctaatctaagataatctccctatttgaaagtcagctgattagcaactttaattctgtctgctgacattaattcttatctgctatgtaaagaagcataatcataggttctaggaattgggacatggacatctttgggaggccattattatgcctactacacctagtaaaataaaactcggtgtagcaaataaatactttggccacaaaaattgtctttaaggagaaaaatgtctgtgaataactttttagtatatggacattgcaaatatcatgggatatataatgtaaactctacctaaacttccaggcaccaggagagcaacaaattcattcaaactaaaaatgtcacatattataaaaattaaatgattaaataaataagactatcggacaggcctgggaccaaggtgaggtgggtaagtttgagttggacaatagcaggattagattctgtccttatttaaaacttgaatattttgtagatcatgtgttacttttgaatcaatttttttttttacaaaaaaaaaaaaaaaaaaacacatacattataagatcacttatcttgagtgcagaattttttgatccccaaattctgcacctgcatccagtgcctccctcacctcttggcctggttaaaggatctacaaaaaatctctaggtctgattttttttttccaatcttgatactctaggaaatccaatggattattttagacaaaaatgcatttagctagaggttgatggtaggcacattaagagaaaagttaatatcaagaaacagagagcttcatagacatgtagggtatacctgcagagttcacgatttaactatcaaacgagttaaactgcccaacgagagagggcagggctaggcaggcatcttgatgcttcccctcagagtctatactgtctttcttcttgaggtttgctctcctctcattgtgttctgcgctatattgccctcatttaactgtaccttcaaaaaggacctgtttttaagagcttttacatgaatcaaaattatgtctagatgtgaggaaatgctttgtgcaactcaactttgccattaaatgtataataatttatgaagtaacaactcttcctcaatgaccactacatacatgaataagagaaagtccatacctgtagagagctcatagactattggagaagtaaaaaattaaccacatgagcaggaagcacaattgcataagtaggctaaaccagaaggagggagtgcttgtgaagaacaggaggatagggcgttccctccttagtggatcaccctgattccaggaggaaagaggcctttgagttgggacattaatgaggcacagtcttccaggaagatgtggggtaggtgagggcacgcaaagagaggaagtaggaggagcaaagcacagttataggaaaacaatgggaataattggggaaggtcaagggacctaaagggaacagatgtcactaagcctcccccaaatcacagcagtgccagtctccttgtcagaaacttatgactcataattattcactcacatctcatgatcatgatggaaaagctcaggtttggaaaagaaactcaccgtggatttattcaagatgatactgacacagactttgtgtctttctgacatggggttttgaattctaacatcccgttgctcctgttggttttgggttgctggaggagcaacccaaaaaactcctcctgtgccatccctgacccctggtctggagagctgggaaggacattccaaggatgtcagagattcgcttgtccgaaaccaacattacacaatcacaattgcaattactaggataaagattccatgtcttcgaacaccgtagcttaatttggtttaaatgcggcacgtctctgctgagtgagccctttctgaatccacattagtcacagaagcttcttggactcctcgttactttttgcagcattttattctgtcatggccataggtgccaatctgtttcaagcttgtagagcaaacattcagaacacacacacacctttattcctgtgtcagctagcaggatttcttatatctttagaaaaacctaaagaaaggaaaagaaaaaaaagaaaaaaaaccgagaagcaataaacaataagcaaatcaaaggacaataggagtgatagggtgttagaattcaaaaccccatgtcagaaaagcacaaagcctgtgtcggtgttgacttgaataaatctctggtgagtttcttttccaagcctgggattttcatcatgatcatgagacatgagtgaatgatgacgtgaacctaagtttcttaaaaggaggctggccctgacgtggtttgggaatgtttagttcctggaaccagaatgtgaaagaccgatctctgctaagtgactggggcctccagatgggctcaggtagcagctcaacaaggatttcttgagaattcagctccaccacacaaaaataacctcaaagctaccctacctccatttacacacacaggccagtaacctctgctttccaaatcatgaagtccgttaagtttttaaaatgagatgcaagaaaaagatgtggctcaaatggcagaaattgtttaatgtgaatttaatatgaaagtaacttagggccgggcccaggggctcacgcctctaatcccagtactttgggaggcctaggtgggtggatcacctgaggtcaggagtttgagaccagcctggccaacctggtgaaaccctgtctctactaaaaatacaaaaattaactgggcatggtggtgggtacctgtaatcccagctacgcaggaggctgaggcaggagaatcacttgaacccaagaggcggaggttgcagtgagccgagatcatgccattgcactccagcctgggtgacagagcaagcctctgtctcagaaaaaaaaagaaaaaaaaaaaaaaagaaggaggggcaaggaggggcagggggaggggagctgggaatgaaaaaagacaaataaaagaaagtagattacaattaaaaacaataattaacagtagaagtaaacctttgtaatgaattgtttctaatctctaaattctcttctcaatctcacccttccatttgtcctccctccttcctttcctcctttcctcccttttgtctcttccttcatactctcctaagtggtggaatatcgcccaatgtctgtgcctccaggagccctgctgctcctctgtaacccaaaatccataaacaatatggataaaatgaggctttttctatgtaatttctatcagattagacatctcaggtcttagtctcaaattatctttctctctcccttcctcccttccactctccttttcttccttcacccttttattttattcttataacatcaaggagaaaataaaattaggcattccattttaaaagtggctttcaataggcatttttgttctgtgaacctagagcagccacagagggcaagtgttctccagggccttccatctgaaaagacgaagggccagtgtcccaaacacaacttcccaaagtacaggctgcgccttatcactacctgaaattctctaggtcactcaaatctacactttaaatataaaaatttagaaaatgacattctgtacttacttctttggataaaatcaaaatttctcacttttattgaaaaataaaagtcacctgacagttttcaaccatagtcttagcagtcatagagtgaagatcagggaggagatgagatttacaggctactgggcccctctggcttagaagagggagtgaggcggccatgaagctcttaaactcctttcatattgaaggaaatggagtttggttcaacaaagcaaggcatgcaatctactcagtctagaagtgatagtagaagaaagagagaaagggacaaagggagtcaagctgtaggggagacagggagagagggagtgccctgacactgagagaaatacaagaggcagagaaaggagacaaaggagagatatagacatgagagacagagaaaaagagagagagtgtctacggccatagcaccttgaacatgtttgatctcctctgatcttgtaagctaagcaggagtgggcctaactagtacttggatgagagagaaagaggtgagagagaggcaagagagagcctctaccccatttttccacttttccaagcctcctatttccctgactcatctcatgtggaagaggcatcaggaatatgaagcggaataagaagagaagataaggacccttatgggtgatggctgggagcttcaccatgagctgaggctggggaggacaccgagccttccatctaaacaggtcttggcccctggtcactgggcagaatttggaacaggtattgcctaccacatcagtaattacagtgattgaaactgaccaccttactgggggcatcagacaaatggccctctgagagaaaagtatacccaggagctcttatgcaaatttggacacaagaaaccccagaacatcccctcgttctgctcatatgaccagggcttctttctgtcttgtatcatttgggacctgggatgtgaatggagtgaggggcaaggtctttcttacaggggaacagactcagggtctgtgaactggagatcacctgcctgctctgtgggatgtcctgtttttcctgaatgtctagggacagtctcaggccaaactgggagccggttccatctagttctatccattgctgggacattcagctcctggggatgatacagggctggctcaaacccagggacctgggaggggctcacggcttctggcagctccaggagcatggtgggccccgtcctcacagatctgagctggtgaaattcatgtgaaaggtgccctgaaattctccgtcatcaccatgggacagagatgaggcagatgggtgcccacttccttcctctgagaaggagaatgggagggtgggattgtgactacatgtgtcccctcagagtccacccaggcccaggccaggaggtggcctaccacccacacttgagttccctccattcacaccgacactcagggaatgtcagctccacaggacttcagggctttgggagccagggctttccctgctttccacagacgtcagtgctaagtgagctcaataccgttgggatttggtagagaagcacggagtgggggtgcaaggcctccacgtggtgtctttcacgtgcatccgtgtgaagagaccaccaaacaggctttatgtgagcaataaagctttttaatcacctgggtgcaggtgggctgagtcagcgtagggagataggggtggggccgttttacaggatttgagtaggtaatggaaaattacagtcaaagggggttgttctctggctggcaggggtggaggtcacaagttgctcagtgagggagcttttgagccaggatgagccaggccaaggaatttcacaaggtaatgtcatcagttaaggcatgaacagtccattttcacttcttttgtgattcttcagttacttcaggccatctggatgtatacgtgcaggtcacaggggatatgatggcttagcttgggctcagaggtctgacagtctccctattggtgatgggacccacttctgcagaagccctgtgttttcagagctgtgcaaggtctctggggaccctcaggaccctgtccttcctccataacccagagtagcaatcggtggccacaggcaatggacagagcccctggtgtcagatgctcaggggtggggcttttcaagggaaaataagtggcattcatcctggttcctccctctttggatccaagggaagcttgagagacaagcaggccccagtgtcaggtgtagcgatgacaccaaggtgtagcggtgacagccatggggacaatgagccttgagccatggtctacattttaaatgtcacactttaagaattcacagtttgaggcaggccaggggtgtttttaaagaaagctgcaatggattctatgaacaagatctttaatgtctttcttatcatgaaaggaagtttccgatggggtaggcaaagagagggctgggttgggtgccctcacaactgctaaaggaatctgaatccagggctacagctgactcagcagggagtcactccctttgtcagaactttgttttcctctgtgctgagcaggctggaattgaggggcagactcattcatttcctgacactaaaactattcctggccaaggaagccaaatagaaaaactgaatgaaaaaaaaaaaaaagcacatatgtgctctgtctaaattaataaataatttaaaaaatatactttctatgtcgctgtcaccttttgaaagtagcaggaaaatgtcatgacacttcaccctaattatctcagcatgtatctcttataaataagaaaaaaattcccgcatcaatcacactaccatttatgcacattaacaagaaaatttccctggcctgaacactgggacagcagctgtaggtgctcaggaagcaaagtgtcagtaaattattgcaaaacagaagtcagtgcatagacattgaaattgttccaagaatagcttcgtggctgttgagttttctgggtacatgttcaatccagattcacacatcgaattaggttgtcacgcctctttccttgttgagtaaacattcttaaggaaatgccatggtatgtggcaaggggccttactggagttattacgtaactcttatatgtaaataagagtttgagttaagagagtggttcccatctttttcatgtgtggcatcactcctgattgatacgtccttaatgactgctgtacttaacatgattattataaaagtaatacacttgcatttaaaaactcacccatagaagagtgtgaatttctcctataatcccgttgcaatcccaggaaccactgacagcactgtggttttacacttgttgtcctctctagctctcagtacatttgtgaggccttgttagagaaggaggtgaaattgctctgaaataggaaagtcactgtgaaatgcagcacctgtgtccctggggaagaagccaccaaggcttagggaccatgggcctggttgctcaaggacagctgggctgactgttcccatgaagattcctatggttgcagctattcttttttcctggcacagcccgatgtgactccttcagagcagtgttcatcctggtgatacagtgtgtttgataaagatcaagggaggagcacttttgtcttaaaggtagggttattatcttgcttcagcaaggaagactatccaccagcacagatatgggttttttcccaaaccacaggctgttttctgtggcaaagtggctcagttccccaggcaagagtgggcattcctttagataggctcccagaaagcaaagtctctcatatctataattttagaaagcaaagtttctctgcactgtgtcctcaatgataaataacagaagcagttttactggctctcaattctggagccaggaccagcttcacgggcttgagggctgggcagtgacacagggacctgccctcagaagggccagtgcctggtagcaggctctgccgacaccctcttgaccttagttttttttctttgaacttcattttgtaagtgaagcccactgagacaatggagcaggcacatgagcagagtggctatgaggggggacaaggtgggcaggctcaggcccagggacatgaaggccacatgttggagcttgctgccctgagcacgggtgctttggagcggcccaggcacatctcgactgggaaggaagatggcaacggaccaggatgggaggtggcagccgcagcagcaggtgtcctcagccctggggtgaaaggagggtctctgtgtggacgcagcactgacacctctgtgcctgtgcattctcagagtcatccttggagcttctgcacgaatatctaccccctgacctgagcaccaggacaggaatcatagggctcagatagcaaattgggaggagagaagcacaaaacaaaagtgtgcccatggacattgtgaaagagtatgccagggagttcttggaattcctcagagagtttagagttcttcaaggagttatccaaggctcagaaatataaattaaatatataatgatagtcacaaaacttctgatgggacaggcatggtgggtcacacctgttatcccagcacattgtgaagctctggttagaggactgtttgaagccagttgttggagaccaccataggcagtatagtgggcagtatagttagaccccaacattaaaaaaaaaaaaaaaagattagctgagcacagtggcacatgcccgtagtcttagctacttgggaggctgaggtaggaagatcatacgagttcaggagtctgaggctgcagtgagccatgatcatgtcaacagatggagaccctacctcaaaaagaaaagaaaagaaaagaaaataacacttctgatcaatcaattattaacaagtagagcaattttaaaaattcagttcttcttgttaaagatacaacaatagaattcaaaaacaggagttttgagtaagttacaaatcatgacgccacatttggtctgctgtgggcctctgcaacttacagaacatgtcagaagatgcatcaaaattccattggagaaatttacacttaaaattaaattcaaacttccataaaactgatttgcttaaacagttatatgctttgaaaaaaatagctccacaagaaccaccagctacagatatactaaaatttgtgtcaaaatagtttatcccaatattgtcagagtttagataatattccagaaacagttgcttcagcagattcttttcagaagaaaaaatgaagttgctcaaggtataaagtttgatgacctaataaattaattgcagaaaagttggccagaaaaattgtttgattcatctagatccaattaataaagtattattatttattctattaaaactgtgacactggtttctggtggggatttatatgattctgttcttactcttctagaagtattatccctattacacttttcaaatgatgaaacatactggcttgagaaagctgaataccctcctgcctttcacgacactttcttctgctgctctttgaacaaggcgccctgcatttccactttgcactgagccttgggaattttgcagccggccttgccgtggccatttttatacaagttatctcatttaatcctcagaagcaaacatgccagggggttattacccaagtttacagaggcaggtcctggggcctagaaaggttagaggacatgttcaatgtcatctgactactaagtggcagagatggaatttgaaataaaatccctctctcttcaaagcccatgttcctaaccagcaccacacaatcaccatggtgtcctgataacctccccctcttcatcctcctacaaccccaaagctacagtaacgctctgcgtaaggccagagtccacgcggctactgtcaccctctcccatctcctgagctgagcggtgagtccacagcctggcccggccttgcaggaggtgagggaatgagcgcgcagttactgccacctcgtggcggcctgactacatgaccctgaaacgcagacctaatctgtttcctgcctgcctgaagcctgggtgtgcacctgagacttctagtaatttcctttttccccttaaggaacctatcgagagttctcacaattttatgcattctctcaagcaagtagctttcgtttatttatttttaatattctcttttgtgtccacattcttttttattcactcgttttcctatttactttcagcttaattagttcttttttccccaggttttttacaatggaatattagattgtctatttctgagctttcgacttcgcatcataatagcagttaatgttatcaatttccctccaagcactgcttttgttgtattgccacaaattttggtatgttatgtttccatttgctgtcatgtgaaaatatttttaaatttctcctttgactcattagaaatatgttgagtaatgtccaaatatgtgaggaattttccagctattttcctttagtcacagcttcatacattccactgtggatagacattacgctacatatgattttaaattgttttgatttttttgtttcttagtccaatatgagctctcttaggtaatatttcaatgcattttactgttattgggaggagtgtcctgtaaagcttatataggtcataatggatgatactgttgttcaagttctctctatctttatttatactttgctgctaaaaaaactatttcaaagaaaaaagtgttgaaatattcaatggtaattcttaatttttcaatttcttctcttagttctatcaatttctttttaaaaattttgagattctcttattaggtgcatactaatttaataataatgatatgtgttcttggtgatttaacaactttatcactggaaaacataggctctttatcagtaataatacaccttgctgtaaaatctactttgatttatagtcagttagccgatacagctaattctgttttcattagattaatgtttccatactataactctttctgtccctttactatcaacctatctttgtccttatatttgataaagacattgggtttttatagacagcgtgtatttgggtcttgttttatactacaagtttgctagtgaggaattctcttagtttttgttattgtcattagaaaatgcctttacgcggtgggtcacgcctgtaatcccagcactttgggaggccgaggtgggcggatctcgaggtcaggagatccagaccatcctggctaatacggtgaaatcctatctctactacaaatacaaaaaaattaaccgggcatggtggcgggcgcctgtagtcccagctactggggaggctgaggcaggagaatggcgtgaacccgggaggcggagcttgcagtgagccgagatcgcaccatcgcactccagtctgcgtgacagcgagactccgtctcaaaaaaaaaaaaaaaaaaggaaaagaaaatgcctttacttattactggaatatgtgtttagcattaatctagaaatgtatttttgcttgtcagggtcctatgttgacttatttttcttcttttggtacttaaatatgtcactttattttttctacttctgtaagcagtgtcttctctcagcatgcttttaagattttctcattatttttgattcaaaacaatttgattattgatatggtttggctctgtgtccctactcaaatctcatctggaattataatcccataatccccagtgttggggggcaggacctggtgggaggtgattggatcatggggaggtgaattctgccttgctgttctcatgatagtgagtgaattctcaagagatgtgatggttttataaatggcagtttccttctgtgcttactcttgtgctctgtctctcttcctctctctctctccctctctctttcgtctgacactgtggaagacttgcttgcttctgcttcaccttccatcacgattgtgagattcctgaggcctcctagccatgctttctgttaatccagcataactgggagtcaaagaaacctcttttatttataattatccagtctcaggtagttctttatagcagtgtgaaaatgaacttgtataattatgatattcttgttcttttttttttaaataattattcttcttggatgtctttcaataccaaatttgtatgtttccagtctcaccaaatttataaaaataggctattatttcactaactttatgctttctcctggaatttctttctgccttcaaacacacataggtgctagattgcttgatatttctgtgaagtgcactgtttatttttcatccagagtttttttctccctttgcttcattttctcatttgtttgtgttaatgtagactcaggcttactgatcctttcttctatactgtcatgtgtcattaatccaattcagaaatttttttgttctcatcattttgttttactgctggaaggcccatttggttctttttatgtgttcctcctcatcaaaaaggttttctcttcagcctttgacatatttataacttttataatagctcctttacattcccttttctgatcctagtacctttgtcattattgggtctgtttttactgaatgacttttctcctagttatgggctatattttcctacttcttttcatgcttggaaattttttattggattcagtatattataaagccttttttttttttaatttggaaacagggtcttgctctgttgcccaggctggaatgcagtggtgcaatctcagatcactgcaacctctgcctccctggtttaagcaattctcttgcctcagcctcctgagtacctgggactacaggcctgtgccaccacgcccagataatttttctatttttagtaggcataggttggcctggctggtctcgagctcatgccctcaagtgattcacctgtcttggcttccgaaagtgctgagattacagtcatgaaccgccaggcctggacagcttgaattgttgagtaacagttttggttgttttccccaaagaatgctagacatcatctggttcattttgggggttctatacattcatttggttttttcaagaatggcttgaaaatttcttgaagcagttgcagagcagtttaatctagagctaactagcaccactacttgctgatggctttctgaggttctgagttctctccactttgctgtggggatacaaagttttcaagacttgtctgtcctcctgaaaatgccgttcactcccttatggagtttttacttttttctggcctggggaagtcttagcccaagtgtgcacacatcataacatagcctaagagtgaaggcattcttctcttctccaacactcaagatcaatgcttcctttcagtagcccactctctgatatgtgcactggaaattggggtctgatacaggttggatgtttgtactctccaaatactatgttgaaatgtaattcccagtcttggaggtgggacctggcaggaggtgttggggtcattggggtggatccctcatgaatggcttggtgctgtcctggagataatctgtgagctccttctttgagtcatgggagatctggttgtttcacacagtgtggcacctccccaactctggctccttctcctggcttgtgatactcctgctcccccttccccttcctacacaaaaggaagccttctgaggcctcaaaaggagcagatgatgtcaccatgctactcatacagcctacagaatagggagccaaaataaacttcttttccttatgaattacccagcattaggtattcctttataggagtaaaaacaaactgacacagaaaattgatactgtgcagggggcattgctgtaaagacagctgaaaatatggaagtggctttgtcactgggtactggcagaggttgaaagagtttgtagggcccagcaaaagataggaagatgagggaaagtttggaactctttagaaacttgttaaatgtacgtgaccaaaatgctcacagagatatggacagtggagtccacactatcaagttgttagatggaaaagtggaagttactgggaattagagcaagggtccccattgttacaccccagtcaagagcttggctgcattgtgttcacgtcctagggatttgtggaaagttgaactttagagtgattagctagagcatctggtctaagtaatttccaaggagcaaagtattcaagatatgtagctgcttctacaagcttgcaatcagatacaggagcaaagaaatgctttcaatttggaacttaaaggagaagctgtcaggcgtctcagcccaagccaagccatcgcatcccctgtgacttgcatgtatacgcccagatggcctgaagtaactgaagaatcacaaaagaagtgaatatgccctgccccaccttaacagatgacattccaccacaaaagaagtgtaaatggccggtccttgccttaagtgacgacattaccttgtgaaagtccttttcctggctcatcctgtctcaaaaagcacccccactgagcaccttgcaacccctactcctgcccgccagagaacaaaccccttttgactgtatttttcctttacctacccaaatcctataaaacagccccacacttttctcccttcactgactccctttttggattcagcccacctgcactcaggtgaaataaacagccatgttgctcacacaaagcctgtttggtggtctcttcacacggacgcacatgaaatttggtgccgtgacttggatcgggggacctcccttgggagatcaatcccctgtactcctgttttttgctccgtgagaagatccacctatgacctcaggtcatcagaccgaccagcccaaggaacatctcaccaattttaaatcaggtaagcggcctcttcttactctcttctgcaacctctctcactgtccctcaaccactttctcctttccactcttcaatctctcccttctcttaatttcaattcctttcattttctggaagagacaaaggagacacgttttttccatggacccaaaactccggcactggtcacggactgggaaggcagccttcccttggtgtttaatcattgcagggatgcctctctgattatacacccacgtttcaagggtgtctgaccatgcaggaacacctgccttggtcattcacccttagcggcaattcccgcttttctggggaaggggcaagtacctcaactccttctcgccttgtctctaccccttctctgcttttctgggagaggggcaagtacccttcaaccccttctccttcacccttagcggcaagtcccgcttttctatggggcaagaacacccaatcccttatttccacgccccagcctcttatctctgcaccccaatcccttatttccatgccccaacctcttatctctacaccccaatcccttatttccatgccccaacctcttatctctacaccccaatcccttatttctgcactccgacctcttatctctgtgccccaatcccttatttcagtgcctcaacctcatatctctgcaccccaatcccttatttccatgccctgacctcttatctctgtgccccaaccccttttcccacttttctggaaggtaagaacccccaaaccccttccttccatttctctactctctcttttctctaggcttgcttccttcactatgggcaaccttccatgctccattcttccttctactcccttggcctgtgttctcaaaaacttaaaacctcttcaagtcacacctgacctaaaacctaaatgccttatgttcttctgcaatgccacttgaccccaatacaaactcgacagtagttccaaatagccagaaaatggcactttgaatttttccatcctacaagatctaaataattcttgttgtaaaacaggcaaatggtctcaggtgcctgacgtccaggcattcttttacacatcagtcccttcctagtctctgtgcccagtgcaactcatcccaaatcttccttctttccctcccgcctgtcccctcagtaccaaccccaagtgtcgctgagtctttctaatcttccttttctacagaccaatctgacatctcccttcctccccaggctgctcctcaccaggccaagctacgtcccaattcttcctcagcctctgctcctctaccctataatctttttatcacctcccctcctcacacctggtccggcttacagtttccttccgtgactagccctcctccacctgcccagcaatttactcttaaaaaggtggccggagccaaagatatagtcaaggttaatgctcctttttctttatcccaaatcagaagtgtttaggctccttttcatcaaatataaaaacccagcccagttcatggctcatttggcagcaaccctgagacactttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggcgtacaataacagaaaaaagttgcaattctttgcctccactgtgagacaaaccccagccacatctccagcacacaagaacttccaaatgcctgaaccacagcagccaggcagtcctccagaacctcctcccccaggagcttgctacatatgcaaaatctggccactgggccaaggaatgcccacagcctgggattcctcctaagccgcgtcccatctgtgtgggaccccactgaaaaccggactgttcaactcacctggcagccattcccacagcccctggaactctggcccaaggctctctgactgactccttcagagatcttctccgcttagtggctgaagactgacactgcccgatcgcctcagaagccccctagaccatcacggacgctgaacttcgagtaactctcacagtggcgggtaattccgtccccttcttaatcattacggtggctacccactccacattaccttcttttcaagggcctgtttcccttgattccataactgttgtgggtattgatggccaggcttctaaacctcttaaaactccccaactctggtgccaacttagacaatactcttttaagcactcctttttagttgtccccacctgcccagttcccttattaggccgagacaatttaactaaattatctgcttccctgactattcctggactacagctatatctcattgccacccttcttcccaatccaaagtctcctttgcgtcctcttgtatcccccgaccttaacccacaagtataagatacctctactccctccttggtgaccgatcatgcaccccttaccatctcattaaaacctaatcacccttaccccactcaacaccaatatcccatcccgcagcatgctttaaaaagattaaagcctgttatcactcgtctgctacagcatggccttttaaatcctataaactctccttacaattcccccattttacctgtcctaaaaccagacaagccttacaagttagttcatgatctgcaccttatcaaccaaattgttttgcctatcccccctgtggtgtccaacccgtacactcttttgtcctcaataccttcctccacaactcactattctgtgcttgatcttaaagatgctttttcactattcccctgcaccccttgtcccagcctctcttcgcttccacttagactgaccctgacacccatcaggctcagcaaattacctaggctgtactgccgcaaggcttcatagacagcccctattacttcagtcaagcccaaatgtcatcctcatctgttacctatctcagcatagttctcatgaaaacatatgtgctttccctgctgatcatgtccgattaatctcccaaaccacaatcccttacaaaacaactcctttccttcctaggcatagttagtgcagtcagaattcttacacaagagccaggacagcaccctgtagcctttctgtgcaaacaacttgaccttactgttttagcctagccctcatgtctgcgtgcagtggctgccgctgctttaatacttttagaggccctcaaaatcacaaactatgctcaactccctctctacagttctcataacttccaaaatctattttcttcctcatacttgacttatatactttctgctccccggctccttcagctgtactcactctttaagtcccacaattaccattgttcctggcccggacttcaatctggcctcccacattattcctgataccacacctgacccccatgactgtatctctctgatccacctgatattcaccccatttccccatatttgcttctttcctgttcctcaccctgatcacgcttgatttattgatggcagttccaccaggcctaattgccacacaccagcaaaagcaggttatactatagtacaagccactagcccgcctcttagaacctcttatttcctttccatcgtggaaatctatcctcaaggaaggaaataacttctcagtgttccatctgctattctactactcctcagggattattcaggccccctcccttccctacacatcaagtcaaggatttgccccacccaggactggcaagttagctttactcaacatgccctgagtcagataactaaaatacctcttagtctaggtagatactttcactggataggtagaggcctttcctacggggtctgagaaggccaccgcagtcatttctttggttctgtcagacataatttctcagtttagccttcccacctccatacagtctgataacacatgagcctttattagtcaaatcagccaagcagtttttcaggctcttagtattcagtgaaacctttatattccttacagtcctccatcttcaagaaaaggagaatggactaaaggtcttttaaaaacacacctcaccaagctcagccaccaaaaaggactggacaatacttttagcactctcccatctcagaattcaggcctgtcctcggaatgctacagggtacagcccatttaagctcctgtatagacgctcctttttattaggccccagtctcattccagacaccagaccaacttaaactgtgccccaaaaaacttgtcatccctactatcttctgtctagtcatactcctattcactgttctcaactactcatacatgccctgctcttgtttacacggccgttttacacagtttttccaagccatcacagctgatatctcctggtgctatccccaaactgccgctcttaactcttgaagtaaataaataatctttgctggcaggactatgatgagtctccttaggcactctctaatcagatatcctgagtcgtcccaattcttagaccttttatacctgtttttctccttctgttattccatttagtttctcaattcatccaaaagcgtatccaggccatcaccaatcattctatatgacaaatgtttcttctaacatccccacaatatcaccccttaccacaagacttcccttcagcttaatctctcccactctagattcccacgccacccctaatcccgcttgaagcagccctgagaaacatcgcccattctctctccataccaccccccaaaaattttcaccaccccaacacttcaacactattttgttttatttttcttattaatataagaaggcaggaatatcaggcctcttagcccaagccaagccatcgcatcccctgtgacttccacgtatatacgcccagatggcctgaagtaactgaagaatcacaaaagaagtgaatatgccctgccccaatttaacagatgacattccaccacaaaagaagtgtgaatggccggtctttgccttaagtgatgacattaccttgtgaaagtccttttcctggctcatcctggctcaaaaagcaaccccactgagcaccttgcgacccccactcctgcccaccagagaacaaaacccctttgactgtaattttcctttacctacccaaatcctataaaacggccccatccttatctccctttgctgactctcttttcagactcagcccgcctgcacccaggtgaaataaacagccatgttgctcacacaaagcctgtttggtggtctcttcacacggacgcgcatgaaagaagcaaagcataaaaatttggaaaatttgcagcctagaaatttagtagagaaagaaaaagcattttcagaagaggactgtaaggggctgtggagaaaccacttgctagagagatgtgcatgactgagaaggagccaagtgctaatagccaagacaatggggaaaaggcttacaaggcatttttgaaaactttgaggcattccctcccaccacagcccacaggcctaggaggaaagaatggtttcagtggccagacccaggcacagctgccctgctcagcttcaagacacatcctggctgcccagcctccagcctcagctcaaagggcctaatgtacagattggccactgcttcagtgggtgaaagccagaacgtcttggcagcgttcatgtggtgctaagcctgcaagtctgcagagtgcaaaaaggaaggaggcttggcagcttccaccgagatttcagaggatgtgtggcaaagtctggttctccaggcagaaaactgctgccgagggagagtaccaagagaaaaactctaccagggcagtgctaaggggaaacgtggggttggattccccacacagtgtccccagtggggcattgcctagtggagctgagggaaggggaacactgccctccagacctgagaatagtaacactgttgacagcttgtaccctcagcatggaagagccacgggcatcagattctgacctgtgacaggagccatgtgggctgcaccctgtaaagccacaggggcagagcagcccaaggtcttcagagcccaccctcacagcagaataaaggacatggaatcaagaattattttcaaactttgaggtttaatagctgccctgctgagtttctgacatgtgtggggcctgtaatcccttttattggccaatttctgccttttagaatggtagtgtctagccaatgcctgtgccatcattgtaacatgaaagtacataacttgtttttgatagtacaggctaaaaggcggaaggaatttgagtctcaggggatgagattttgaactttggacttttgattaagttaatgctggaagtagttaaaactttggggagtgattgggaagggatgattgcattttgcaatgtgagaaggacatgagatttgagggaccagaggaagaataatatttttcagatgtttgtcccctcgaaacctcctgctgaaatctaatcctcagtgttggaagtggaatctggtgggaagtgtttgggttgtgggggtgaatccctaatgaatgactaactgctttcatcacaaaaatgagtgagttcttgctccgagttcatacaacatgtagttgtttaaaagagtctgggacctccttgcaccctctcgctccactcttaccacgtgatattcctgctcccacttgactttccactatgactgaaggcttatggagtcctaacaaggagcggatgcaggcaccatgcttctcacacagccaaaaatagtgagccaaataacttcctttcctgaagtattatcccacctcaggtattcctttagagcaacacacacagactgacacagggcgtatcgtgctgtgtgagctttgaccttggtctcctcaatgctacagggtgctggtcttcatgtaagtcttcctccctgtgctgtggcctgtaacctggccctatagagagctaggggcaaaaggacatcctactttatttgtttgttgcactgcttattatccaatatatgaacacagctgtctcacacctgctgactagttccatcttgtctactgtaggagggcaattcccatagcagtgagtccgtttggatggaaactgaggaacaggctcaactttttcagtttttgtcccttcttcctgagagcctcattgtcttttcatataagccttcagaatttgagaaagatatacataaaattccgtaaaatgttggtaggttttcatctttgttctccattacagaaatgtagccttagcttttttgtgttactaattttatgctcagtttataatttgaaaccagtaggcccttcctattcgtgtgttccacatcaggaaacgttctacaaaaacattgtgtctgaattgagcatgcacaggcctttttctcttgccattattttctaggaaatacagcataactcctacttacttagcatttacattgtgttcagtgttacaagaaatctaggaatgatttaaagtatatgcaaggagtgtgaagattatatgaaattactactcttttatatcagggacttgagcatctgaggcatttggtatacacagggggtcctggaaccaatcccccatggatactgaggagcaattgtatttgtgttctgtttctaagcaaattgtcataagcttagtgacctaaaccaacacaaattatcttgctgttttggggatcaaacatgaaaaatcaaagtgtccttaggacctttttcctttccagaggttctaagaagctgagtttgctttcctttttttttttttttcttctttgccttttcaaatctgagaggctgcccatgttccttggtttgtggatccttccttcatcttcaaatccagcaatggctgttgagtcgttcccacatcgcatcacccagacactgactgttctgcctttcttttccacatttaaggattcttggattacgttggtctcattcacatgatctaagttaatctcccggttttaaagtcagcatatcagccaactattctatctgctgtcttagttcttatttgccgtaaagtgtaacataatcccaggttctagggataaggacatggacatctttgggatgccgttattacacctactacacctagtaaaataaaattcagtgacgtaataaatactttcaccaagaaaaatatctttaaagaaaaaatgttttcagtgattcatagtgttattagatgaatataggaggccaagttcaatttggctttcagaaaaaccatgaagaactttttagtgtatttaatcccaaatagtatgagatagataatgccacaataaactggatgttgtttatctaaaactcacatttaactgagtgtcctatacttttatttgctaaatctgtcaaccctagtcatgtaggattaatacaaacaaatacatgtttcttctaagttgctcacatatgagagcaaaacaaagaaaagtacatttaaggttctatcacaggtctctcagaaaaagtttcctggatgtgttatcatcccccagataccctacaattagatctttttgatgtttctttagtgtttttttaattatctctctttgatcaagaccttcactgaaatgtattcttttaaaagcaaacactccttcattttggattcattaagagacagatgttagcatgaaaaagcccatatcccaagaaggctggggcatctgaaacatgtctgacccttttcatttttgaatagactctcctgtcttatgtaaaaatattaaataattgaattctggtacttgatacaatatgtgaagtcaatatcacaatagatgggattaatagcaaagtgaccagagcagagtagaggatccaagaattaaaacacaggtcagtgggctgggcacggtggctcacgcctgtaatcccaacactttgagaggccaaggcaggcgaatcacttgagaccaggagttcaagaccaggctggccaacatggtgatattctatctctaccaaaaatacaaaaaaaaaaaaaaaatttaactggatgtggtagagggcacctgtaatctcagctactcagaaggctgaggcaggagaattgcttgaacctgggaagcagaggttgcagttgagtcgagatcacaccactgtactccagcctgggtgacagagcaaggctctgtttcaaaaaaaaaaaaaaaaagtaagaatacaagtcagtggaaaattttcaggttgaagtgcagagatataaaataatgaaaaatacaaaaaattgcataaatatatatgtgaaggcacagtaaaaggatgctttgtatatgtgtgtctgtgtgtttgcattgagtatatatgcaatacacacatattgcatatgtgtttgtgtacatacgtatggttggtgcaaaagtaattgcagtttttgccattacctttaaaggcaaaaaccacaattacttttggaccaattctctatctatctagacaattctatttccaggaagagaaatgagcgagggacagcagcaataactgaagaactaatggctgaaaatctgctcaaagcaatgatattattccacatattcaaaaagctctgaaaacaccaagaggatgtgtcaaaagtaaactctacctagactagtctcagacaaaccctgttctttggagagtttcttcatctgctttaaatatagttggaacaagatcagttgctaattttgtagccaggtgaattcaataaaatgatgaatgagcttcagtgtttaaaattaatacctttttttttttcttatgagtcttcaggcacgatgaaatgggaacaattttattctgttatgtcatgagttcacaggttcagagacttagagtatgacttgcaagctcacttggttggaatggattctgtgaattctgtaaactcccggagttatcctatttttgaccatccaaattaaacagctccagctcccattcctcattagtgtagacagccaaatgtttctcagaactccctacaggtgcttatgctcctaatatcttgtgcaaattcttatttctgtcttctgtgtgacattctctggccacctccacctcactcctgcaaccaactacccattttctttgtagctttgcattaagaattactgaggctttcccccttttccaagaattttcaaatacacagcaattgattgagacacagttttgcaaaaacataaggataatgacgggtggttaatgcacagaactgttaaaaataagaatagaaatcagagtgcattctagctaaagagttcagccactcttggcaataacctctacaggctactttgtgccctgatgttacaggtatacctgctccttttggaacccagaactcctttcattgttaatctctgagggccaagaaacctttaacattttatttttagaattgtagaatgatttagcgcttatggattgtatctctatttcacagatgcagtcaggtgtcctatcttccaagacctaaacagccattaaagggccttcttaaataaaaggagagtttcttcctaagagagttgtgctgtttcccctagaacataggaatgaatgtcattgtcatggtgacttttactttttgtgtgtgtgtgaagcttcacttcttttatacagtcaaatgatatatgcttccaggaatcaagaaatccactaatttattcaaaataacaacgtatatacgatgaatattaaatgactaaataaaggcagggtctgactatcctggcatcaaggtaggtgagtgcgactgagttggacaatcacaggattagaccctgtcttggtttaaattttggagagtttgttaattatggtgattttttcatgaatattattttttaaaaatctatcgcattataagatcatctatcttaagtacaggatatcttagtgcttacattttatacctgaggccagagcctccctcgcttcgccctagtcctggctctgtcatcacgtctggataaaatctatatccagataaaaatgcttttactctaacaaggtctggttacttttttcaatcttgagattaggaaagacaatggattattttggaactaaggtgcattttcccagacgtagatgatatgcacattcagtgcagagctaatgtgaagaaatagagagcttcttatgcgtctaggatacacccacagagttcatgatttaaggaccaaaccctcccaaggagagagagcagggccagggagctatcttgatgctcccccttagagtcgatgagtctttcttcttgaggtttgctcccctctgcttgtgtcccatgccatattgtcctcatttaattgtgccctcaaagagacttgtttttaacagcatttacttggatcctattatgtttgtatgtaaggaaacccttgtacaactgcattttgccatccaattaatgaaatagtttatgaatggccagcacataaatgaataagacaaagtccacactagtagaaatctcatagctaaatggagaattaaaaattcacgcacctctgtaggaggcataattgcataagaaaccttagccagaagaagggagtccttgtgaagaacagaggactgggcatcccctcccttggcagatccactatgattccatgagggaactggtctttgagttgggcttgctttttttagggaagatgtggggtaggtgagggcatgcaaggggaggatgcaggaggagcaaagcacacgttttaggaaaatgccgggaataaatggggaaggtcaaggaatccaaagaatacagatgcctgtgaccctggaaagcactccaagccccgctgtggcagccctgaccccttcctggagagcagaaaaaggtgtttcaaggatattagagatggcctgcccaaaccaacatcacccaatgaccacaattactaggataaagattgcgtatctttggacaccatagtttaatttggtttacatgtcgcacgtctctgatgagggagccctttctgaatccgcatcagccacagcagcttcttggcctcctcatggctttttgcagcattttgttccagggagaccacaggtgccaatttgtttataccttctagggcaaaagactggatgacatatggctccactcttaaggcaggtaacaggatcgcctataccaccaaaaacacctaacagggaaaaaacacacaaaaagagcaaacagcgtgtaagaactcaaaactcatgttggaaaaacacaaaccctgtgtcagtatcgccttgagtaaatccgcagcgggcttctttctcaagcctgggcttttccatcatgataatgagacgcgagtcagtcatttggatctaagtttctgacatggaaactggcactgctgtggtttgggggatgtttatttttgtagaacctgattgtgaaagaccctgatctctcctgagtgactggggcctccaggtggggtctggtaggagctcagcaacgatctcttgtgaattcagctccaccacaagaagataatatcaaagccaccatacctccattttaacacacacaagccagtaaacttttgctttttcaaatcatttagtctgttaagtatttgatctgagatgggataaaaagatgcaacttactgaaattgtttaataggaaattaacaccaagtaacttacagttgaaaaccacaattaaccatagaaataaattttgtaatggcttgtttctaatatctaagtcctggtttcaacctcattcttctttttttatccctccctccctccctccctccctccctccctccttccctccctccctccccacctgcccgcctccctgcctccctgcctccctgcctccccgccttccttcattatactgttctaggttttggaaaacatgaggtctctggtgcctctcagaaccccattgttctcacaaaacccaggactcataaataagattggtaaaatgaggatttcacaagatgatatctattagattaattgttttaggatttactctcaaattttctttttccctttctccatccttcccttccactctccctcttttatcctttcatggtttttattttattttcataatatcaaggagaaaatgaaggttaggcatccaggtttaaaagttggtttcaatgggctgtccctgtcctgtgaacctgcagtggcctagtggcagggactgttctcagggcctctgatcagaaaagtcctgggggcagagtgtctgctgcagtagttctcacagtataggctgggccttaagattatctggaattctctaggttgcagtatctaccctttaaatataaaaatttagaaaatgacattctatactactttctttagataaaatcaaaatttctgccttttatttaaaaagtcacctaacaggtttcaaccatagtctcagcagttgtagcatggaaagcagtgaagagatgatatttacaagctactgggctccttcatattggcttagaagaacgagtgaggtgtccattgggttctcaaactccttttctattgaaggaagcaatgcttggttcaattaaatagggcattcagtctaaaagtgtgggtagaagaaaggaaagagaaagaaagaaagacatgctctagggagagaggaaaaagaaagacagaaaaaaagagagagagggaagaagagagagaagcaggagaaaaggatggaggggacacacagagagaggaaggagagagagggatgagggagagataggtggaggggaatgagaggagacagagaacttctacgccattcttccatttggccaaccctcctatttccctggcccatctcacctggaagaggcatcagaaatatgaagaggaacgagaagaggagatacaagaccctcatggctgatggctgggagcttcaccaggagctgagtctggggaggacatcaagccttccaccttataaaggtcctggtccctggtcaccaggtagagttcagaactggtattgggtgcaatgctcattacagaggttagaattcagccacttacctggtgagtcagagaatggtcctcaaagaacaatgcacactcaggagatcttatgcaaatctggactcaggaaaccccagaaaatcccttcctcctgctcttgggaccagaaaattcctcctatcttgcaccatttaaaacccagtgtgtgaatggagtgaggggctgggtctgtctcacgtgagaacaaactcaaactcaggacctataacctgccactcacctgctgcccactctgtgcgacgtcctgtttttcctgagtatctggggacagtctcaggccaaattgagagctctttccatctaattctatccattgctcggacattcagctcctggggatgatacagggctggctcaaacccagggaccctgggaggggctcagggcctctggcagcaccgggagcatggtgggccccatcctcacaggagatctgagctggtgaaatttatgtgaaagttcccctgaaactccccatcttccccacgggagagagatgaggcagatggatgcccacttccttcctctgagaaggagaatgggaggatgggattgtgactacatgtgtcccctcagagttcacccaggcctgggccaggaggtggcctaccacccgcacttgagttccttccattcacaccgtcactcagggaatgtcagctccacaggacttcagggctttgggagccagggctttctctgctttccacagacgtcagcgtcactgcccttgggatttggtggagaagcaccgagtggggctgcaaggcctccacgtggtctccctgttggtgatgggaaacacttatgaaggagccccatgttttcagggctgtgtgaggtctctggtgtctctcaggaccctgtccttcctccgtaacccagagtagcaattggcggccccaggcaatggacagagccccatcccgggcactcaggagagggcctttcttgggaaaatgagtggcattcatcctggttcctccctctttcgatctaagggcagtttgagaaacaagcaggccccagtgtccatgtctgtgatgtctcaggggtgcagcagtgacagagacatggggacaatgaggctttcctcatgacctgcctgacctcttcatttaaaatgtcaggttctgaagaaccctgattcctggcaggccagaggtggatttaaaggaagctggtaatgatattgtgcagccaagatccttaatgacatttttataaaaggaaatttctgagcctagcatggtggcttacacctgtcatcccagcagtttgggaggctgaggcaggtggatcacatgaggtcaggagtgtgagaccaatttgaccaacatggcaaaaccccatctccatgaaaaatacaaaaattagccaggcatgatggcttacgcctataattccaggtatttgggaggctgaggcacgggagtcgcttccgacagagcaagactcagtctcaaagaaaaaaaaaaaaaagaaggttctgatggggtatgcaaagagagggctgggtcagatgctgtcagaactgctaaacaaatatgcatccaggactggagcttagtcaccagggagtcactctgattgtcagggctttgtttccttgtgtgttgagcaggctggaattgaggggcagactcattcattcctgacactaaaactatttcttcctggtgaagaaagcatacagagaaatggaatatgaaataaagcctttatgtgctctacctaaattaataatttatttatttttttttgtatatttgctatgtcacctttagaaagtaagaggcagctctcacttgctgctgatgacctgcctcgccatgcacatgtcctgccagcaccccacagaaatgcttccattacccacagtctttcaccagatgagaccagtgtccaggctactggctcctcacctcacttgaagtgatggtaaagatgtaaaatttggtgatgatgtccgagccttaatgcttcaaagtgtagactttttgtcgaggctgtagccattacaatggggccaaagggaagaacagtaattattgaacatagctggggaagtcccaaagtaacaaaagatggtgtgactgatgcaaagtcaattgacttaaaggataaatataaaagcattggagctaaacttgtccaagatgttgccaataacacagatgaagagactgggggatggcactatcactgctgctgtactggtatgctctatttccaaataaggcttccagaaggttagcaaaggtgctaatccagtggaaatcaagagaggtgtgatgttagctgttgatgctgtaattgctgaacttaaaaagcagtctaaacctgtgaccaaacctgaagaaattgcacaggttgctacaatttctgcaaatggagacaaagaaattggtaacatcatctctgatgcaatgaaaaagtttggaagaaagggcatcatcacagtaaaggatggaaaaacactgactgatgaattagaaattattgaaggcatgaaaatttgatcgaggatatatttctccatactttattaatacatcaaaaggtgagaaatgtgaattccaggatgcctatgttctgttgcatgaaaagaaaatttctagtgtccagtccattgtaactgctcttgaaattgccaatgcttactgtaagcctttggtcataattgctggagacattgatggagaagctctaactacactcatcctgaataggctaaaggttggtcttcaggttgtggcagtcaaagctccagggtttggtgacaatagaaagaaccagcttaaagatacggttattgctactggtggtacagtgtttggagaagagggctgacactaaatcttgaagacgttcagcctcgtgacgtaggagaagttggagaggtcactgtgatcaaagattatgccatgctcttaaaaggaaaaggtaacaagtctcaaattgaaaaatgtgttcaagaaatcattgaccagtcagatgtcacaactagtgaatacgaaaaggaaaaagtgagtggagaaactttcagatggagtagctgtgctgaaggttggtgggacaagtgatgttgaagtgaatgaagagaaagacagagttataggtgcacttaatgctacaagagctgctgttgaagaaggcattgtttagggagggggttgtgccctgcttcgatgcattccagccttggactcattcactccagctaatgaagataaaataattggtatagaaattattaaaagaacactcaaaattccagcaatgacaattgctaagaatgcaggtgttgatggatttttgatagttgagaaaattatgtaaagttcctcagaagttggttatgatactatgttaggagatgtcgtgaatatggtggaaaaagacattattgacccaacaaaggttgtgagaactgcttcattggatgctgctggcatggcctctctattaactacagcagctgttgtagtcacagaaattcctaaagaagggaacagccctggaatgggtgcaatgtgtggaatgggaggtggcctgttctaattcctagaatagtgctttacctttattaatgaattgtgataggaagcccaaggcagtgttcctcaccaataacttcagagaagtcagttggagaaaatgaagaaaaggctggctgatgtttaagaaaccactataaccatcagttactggtttcaactgacaaaatatataatggtttacagctgtcatccatgcctacagataatttagtttgtatttttgaatagaaagatcttgtacattcctgacactgggtacaagagccatgtactgatgtactgttttcaacttaaatcactgaggcattttttagtaaaaatgaatagtagtctattctgttaaaatcaggattttagtgcttgcaaccaccaaatgagaagttaagcagcctttctgtgcagagtgagaataattgtgtacaaagtagagaaacttccaattatgtgacaacctttgtgtactaaaaatgtgtttaaagttaaaaaagaaagacgcaaacatcatgacacttcactgtaattatctcagcagaatctcttacatatgaggggacatttccacatcaaacacaatacaatttacacacattaagaaaactagttcctcaatgttatttattatcttgtcaatatttcacatttctccaattgttccaaccatggcttcatggctgttgatgtttctggatacatgtttaatctagatttgcacatcaaatcaggttgtcatgtctcttaatttgttgagtaaatattcttaaggaaatgtcatggtactatgagaagaaccttattggggcttagagtttgaattaagggcctggttgccatctttttcacgtgagacttcattcctgatcgatacattcttaatgactaccatgcttaacattattattataaaagtaatacactcacatttaaaaactcacccataaaagagagtgaatttttcctacaaacctgttccaatcccaggaaccaccgatagcactgtggtttttcacttgttgtcctctctagctctcagtacatttgtgaggccttgttagagaaggaggtgaaattactctgaaataggaaagtcactgtgaaatgcagcacctgtgtccctggggaagaagccaccaaggcttagggaatatgtgcctggttgctcaaggacagctgggctgactgttcccatgaagattcctacggttgcagctgcttcttttctcctggcacagcccagtgtgactccttcacagctgtgttcatcctagtgatgaagtgtgtttgataaggaccaatagaggggcatctttgttttaaaggtagggttatgatcttgcttcagcaaggaagaccatccactggcagaaccatggggctcttcaccaaaaccagagatgcagcaattctaggatttggggacatgtcaagatttggtaaaatatacatgacttttctttttcttaatgagctaaaagcaaagccaggttgtgtgtaaaatgggaaccatcaagtctaactgacaaatagactcactatgctgtcttttaatgaaacattacctgtgctgtgtccccaaacctatctctataactggggagagaatttcaggctgtttctttgtggcaaaatggttcagttccccaggcaagagtgggaagcctcattcttatagataggctcccagaaagcaaactctctcatctctatgatttagaaaacaaagtttctctgcattatgtcctcaatgttaagtaacagaagcagttttactggttctcaattctggaggcagagccagcttcatgggcttgaaggcagggcagtgacacacgaatctgctctgagaagggccggtacctggtgtcaggctctgctgatagctccctgactttcttagttttttctttgaacttgtgttttgtaagtgaagcttactgaggacaatggagcaggcacatgggaagagtggctatgaggggagacaagttgggcaggctcaggcccagggacgttctagagctttgctgccctgagcataggcattcttggagcagcccaggcacatctggactgggatgggaggtggcagcagcagcagcagcagcaggtgtcctcagccctggggtgaatggagtgtctctgtgtggaggcagcactgacacctctgtgcctgtgcattctcagagtcatccttggagcttctgcacaaagatttaccccctgacctgagcaccaggacaggaaccataggtgctcagatagcaaactgggaggagagaagcacaaaacaaaagtgtgcccatggacattgcaataaagtataccaggaagttcttggaattcttcagagagtttagaattctttaaggcattatccaagactcagaaatggaaattaaacatgtaatagtagtcacattcaacagagaaggatgctatatttgtataaaacttctgatgggccaggcatggtggttcacgcctgttatcccagcacgttgtgaggttcaggtcagaggattccttgaggccaggtgttggatactagcttgggcagtataactagacaccatctctacaaataatgataataaagataataaagattagctggccatagtgtcacatgatcgtagccttagcttcttgggaggctgaggtatgaggattacatgagtccaggagtttgaggctgtagtgagcaatgatcgtagcactgcactccagcctgaaaaatacagaccttgtcaaaaaacaaaaaacaaacaaacaaacaaacaaaaaccttctgattaatcaattatgaacaaggagggcaattttaaaaattaagtttttcttgttaataaatacatagcaatagaattcataaacaggggttttgaataagttacaaatcatgatgccatattggtctgctgtgggcctctgcaacttacagaacatgtcagaagatgcatcaaaattccgctggagaaattgacacttaaaattagattcaaatttacatgaaactgatttgtttaaagagttaaatcttttgagacaaattgtttcacaagaatcaccagctccagatatactaaaatctgtttcaaaataatttatcctcatgttgtcacagcttggaatatattccagaaacagtggcttcagcagattcttcccaaaagataaaatgaagttgctcaaggtataaagtttgttgtcctaatatattatttgacagaaaagtgggccagaaaaattgtatgattcatctaaatccaattaatagagtagtatttttattctattaaaactatgaaattaatttctggtggagatttgtaagattctgtcattactcctgtataactattacatttttcaaacaatgaaaaatatttgtttgaaaaagcttaatatcctactgcctttcattacactttctttttctgctctttaaaccatggtaccctgcatttccatttcgcactgaaacttaggaattttgcggccagccctgctatggccatttttatattagttatcttattaaatcctcagaaacaagcctgccaggtaggtattacgcaagtttacagaggcaggtcctggggcatggaaaggttggaggacacgttcaaggtcacctggctactaagtggcaaagatgcaatttgaaataaaatccccctctcttcaaagcccatgttcctaaccagcgccacacaatcatcatggtgtcctgataacctcccctcttcatcctcctacaaccccaaagctacagtaacgctctgcctaaagccaaagtccatggagctactgtcaccctcttccatcttctgagctgagtggtgagtccagagcctgggctggcctggtcttgcaggaggtgagggaatgagtgcgcagttactgccacctcgtggcggctcgtctatatgaccctaaaacgcagatgtaatctgtttcctgcctgcctgaagcctgggtgtgcacctgagacttacagtaatttctttaccccttaatgaacctattgagagttctcacaattgtatggatcctctcaaggaatcagcttttatttactaatttttaatgtttttttgtgtccagtttctttttattcactttttctttttctctttttttttctttttcttatttactttgggtttagtttgttcccttttcccttaccgtttcttacagtggaaacttaaattgtctatttgtgagcttttctgctttctatcataatagcatttaattataaatttgtctccaagagccactttagtggcacttccgcaaattttgatatgttatggtttcattttctatcagttgaccatattttctaaagtatcttgtgatttctcctctggaccatttagatacatgttcattgatgtcccaatatatggagatttttccagatgactctctgtattgatagttttgtaaattccactggagatagacactgtcttttgtataattttaaactatgttgattttttgagacgtttcataggttagtatgagctctattgggtaatattttaatgcattctgctgttatttggtagagtgttctataaatctcaaataggttgtgctggacggtagcgttgctcaagacttctctacctttactaatattttgtctgctttaaaaaatctcttacaggaagagaagggttgaattgtctaattgcaattgctaatttgtctatttctttaatgtctattgatttttctttaagaatttcaaaattctgttattaggggcacacactgatttaatattaatatctgttcttggtgatgtaaccactttatcattaggaaaaatatctctccctattactgataataccccttgctctaaaatctaccctaatttatgtcaatgagccagtatagccaatcctattttctttatactaatgttttcatattatatctctttccatccttttatttttactctaagtttgttcttaaagtttatatataaagtgggtttttatagacagcatgtagttgggtcttgctttttactgaactgacaatctctctctttaaggagcttctagaatgttcacagcatgctcttttcatcatatggaatcaaatttctacctagcatcttccctttctgccaaaaaacttatctttgcattttatagtacagactggctggtgaggaattctcttagcttttattgttgttactggaaaatgcctttacttattatttgattatgtgtttaccctttttttagaaatatacttttgctggggtggatttctaagagaacattttttttctttcggcatttgaagataacacttaacgttttgttcttctgtaagtaatatgtctcctttcagactgctttttagttttatttttgtttttgagacgcagtctctctctgttgctcaggctggagtgcagtagggtgatctcggctcactgccatctccgcctcctgggttcaagagattctcctgcctcagcttcttgagtaacctaggattataggtgcgtgccaccatgcctggctaatttttgtattttttttttagtagagacagggttttaccatgttggccaggctggtctcaaactgctgacctcaggtgatccgctcaccttggcctcccaaagtgctgggattacaggcatgagccgctgtgcccgccctcaggctgcttttaaaattttctttttattactgatttaaaatactttgattatgatatgtttcatgtggttttcttcatgtttcatatttcaacttggatgtcttcatgtggtaaatttgtgtgtttatagtctcaccaaatttggaaaacaataggccattccttccttagctctatcctctctctcaaaacttttcttcttttattcgagatggagtcttgctctgtcgcccaggctggagtgcagtggtgtgatctcggcttacttgcaacctctgcctcccaggtttaagcgattctcctgcctcagcctccagagtagctgggattacaggtgcacgccaccacacccagctaatttttgtatttttagtagagatggggtttcaccatattggccaggctggtcttgaactcctgaccttgtgatccaccctcctcagcctctcaaagtgttgggattacaggtgtgagccaccacgcctggctgtctaaacacacatagttgctagattgcttgatgtttctgcacaggtcactgcttattattttccagcccttttctcctctctttgtactatttcttcattcatttgtagtaatataaactcaggtttactgatctttattttggaatatatgccacaatccaactcatagtatcttttactcagatgtttatttttaatctctggaaattccatttgtctctttatatctctcactcatcatgaacagtttttctcttcaaactcggacatatttataacatttataatagctcatttaaatctttttttgctgatcctagtatccttgtcatttctggatctgtttttactgaatgatttttctcttgattatgaccatattttcctgcatagcagctaattttttattagattcagtgtgctataaagcacaaactgttgagtgatggatttagttgtttttctttgaagaacgttaggctttattctgtcccacatttaagtttctcatagatcagtctggtcctttcaagaatggtttagaaaaaaatttgttagagtggttgcagaacaatttaatctagagccaaatagcactactactaatgtgttagttgcccaaggactctgcagtctctccactttgctagtgggaatgaaaatttttccagcctttagtgctcctaaaattgttatccaatcccttttgggtgtttttctttgcctctagccttgtgaagtcttaccccaagcgtgctcacatgaaaacacagcccaggactgaagatttaccatgtgtccctgcccccaccaccaacacttcggggccttgcttccttctaggcaccctctctctgctattctgccctggaagtgggggtgtcttgtgctttgggaagtttgatttcagtctcttcaatgcttcaggattgctggacttcgtttgagtcttcctctgtgtgctgtggtctggaccctgctgctgtagtgagctgggggcaatcgaaagtctcacttcattggtctgttgcactgcttattatccaatgtctgaacacagctgtcacacatcttgacaggttcccttttgtctgctgtcagagggagattcccatagcagtgagtccattttggatggaaagtgaggagcagtctcatctttttgagcccttgagcctttcttcctaagagccttgttgtattgtcttttctccatacgtggagccatgagtggggtctggtgtcaggtatgaaaaaccacacactccatttgctggaatcctactgcatcaacgttgagagagcactagatagttaaactgcagtacctccaaatcatttgaatgattaaagataattcaatcaataaatcgtttgaatgtacttcaattcataaatacttgttgagcagccttcatgctcagggcactttacaagcagtacaggaagaattaagacaaactccttgcttttaaggctcacaaagtctaatatggagattggcaatatgtcactgtacgcaatgtaaaaaccaagcaagggttgtagatggaggactcaagtcagaaccctgtggtgaaccagaggaaagactgtaagcatttgggaaatcacctgtgtttttaaggtggagataaaatgtgagacggtccctgaaggacaggttaaagtttagagatgaagttggaggagtgaggcagacatgaggtcaaccagagcagaggcatgggtgagagaaagcaaagtgaatatctgaggaagagccagtttccttatttctctgaagacaaagtttttggaaggaattgggatagcccctgagggatgcatgaaaaccttagagatagatttggtggagagatgccatttggggtagagggactgaaaaggcccaaggcttggatgacatgaaagcaaagggcatattccaagagagtgaagagtccaacttcactggggcataacgttcacaaagtaggaatagaacctgataacccttggataataaggttgggctcccttatagatttctccagagattctactttctttgaacgaaaggtgagtccttaagattttctgagttgtctgtttggaaacaagtaccaaaataatcagatttaaaaaaaaaaatcaagctcctaattttttttgaaaaaaaaatgtaatttgattttacttttataaactttaagaaggcatttccacactttacaacactctcgtcatgtttcagggtttttatttctttcttcggcagcattttcggccacgcgtcgagcacttgccgatctgttcctcctttggaaggcagctgagcacagcacaccggccgcctctgactctgcaataatatttctgtaatgtgtttatgattcctccatgacctgcaatgacaaaacagcacacacggaaaggttttaggaaggcttttggtacacgtacaaggcttgtggaattcctcaaataactcatcccttgcttttcttgtattcttttgtttctttttcctttttctataaaatcaggaggaagatgaaggtatgactacacaacccatagacaatgtttctaaggctgcagctcagctgtggacccacagtggcaccggggaagtggcgtgaccctgtgactgccgcaggaacagtgggggtgctgaggctgtggtgtcctcagaggtagccccaacactccacctccaaccattgcacttagtagaacaggagcctgtgcttctattctcagagtaaatcaatctttcctgctacattaaacttttatgtctgattcatgtctcatcagctggtataataatcttcccttgaagagttggggaaagagatagctttggggagctatttagtttcttaatgattcttttctttttttttttttttgaggtgtactctcaccctgtcacccagtctggaggacagtggcgtgatctcggcttactgcaacctccgcctgccaggtttaagcaattctctgcctcagcctcccgagtagctgggattacaggtgcccgccactgtgcccagataatttttgtatttttagtagagatggggtttcaccatcttggccaggctggtcttgaactcctgacctcgtgatccgcccacctcggcctcccaaagtgttgagattacaggcatgagccaccgcacctggcctcttaatgattcttgtctgaaaaaaaagtggtgatgcctagttcccatacaacaaacctgcttggtccaaagcactctgaaggatggagaaatactgactctgaattatatattctcaattagatcaatccttagatttcccagcccatcttacctggaacaggcaccaaaaacaggaagagcaaagcaaacagaagataatggatcctcatagctgctaggcttcaccccacgctgagactggatgaaaaggtgtgcttggtcactttataaaggttccagccacagctgcaattcttgtcatattacagtgatgacattatgacatgttttctgatgcatcattccaatgcctctcaccatgcagaacacacccactcactcagttaattaggaacccaatggtaaggcagagctccctatggatttgtggctgtccgggtgctctctggactccaggggcttgtctgggtgtgggtcagattgggttgtgggtacagatagggctggcatgagcaagtatgccccctttggggaatagtctcagggcatgtggctgggggctgacttgtccgtactttgctgctttggagctttttttctcttcctaaaatgctgggagagtctaagaccctcctggggaccaaataaatccagccctggacatattcaatatctggcaataggactggctttttggtagtgaggtaagggaggaaaatgggctacattcaaggttagctgaccacctggcccttggcctatgatggggtgctataatttgagtgaaacatgtctcattctttcattttttttttttttttttgagagacagagtctcacttttttgtgcaggctggagtgcagtggcatgattacagctcacaacagcttgagctgtcaggctcaagaggtcctcccacttcagccccctgagtagctgggaccacaaacgcatacctccacacatggctaaattttaaattttctgtagaaaataaaatggggtctcactatgctgcccagactggtttcgagcccagatgtgaactcctgggctcaagcaatcctcctgcttcagcctcctaaattgctgggattactggtatgagccactgtgtgcggcccatgtccgattcttcatcattgtctaaaacctaccaaatttatgagtaaagaaggtgtttaattttacttcatcagagaaagaggatgctgggatgatagatttaatagactggcatctcctcctagtcaatgactgtccctgtgcaaaagaggggcttcagaatagacatttaagacctcaagttactcttggctcaggagcattcaaggcagtccaggggccagatgatttcccctgcatatagattcaacgtttagagggaaaaatgctaaaaaagaaaaaaaaaacagctattaaacttaaatgttcaggaatccaatggatgggttgtatttggttgactatcaattgggaactaagtaagtcaatgacaattcaattgggagctgaagtcaccgtgatgtctcctagctgctgcttcgtgtgaatgcaattataacggatccactaaggatcaagggtgtgttagttctgggagtgtgtgttcagaatttgggtgcaccacacctgtcagattcagtaagaaaactctgaacacatactataggaagggacaagtatcatgtcttcagcataggtgagggtgaagtggatgagataccaagagggaccagtcttggttctttctctccagaagctccatgtagggccaggtagatgggcagacagtcaaatgataaatttaggatgaattataatgggagtcataggaagatttcaagcacagggctgcagaaacgtagaagaaagataactcatcataactcaaagataactctttgagccaagagtggagctcaatcagcagatttaagactttagataggtagatgctactttttaaaatctaactttcctctttagttcatgatttgagacaaagcaattggagatatttataaatgggggaaggaggtgagtgtgggtgggatgggtgctgacttcacagtcttactatgtcagacataacgatggcattgggcgttgtagagggttagcaccagctctcagcctggggtgaggacagtcagacgctggagatgacttgcttttccacatggagaatagacttccacaggtgaacccctggtctaacctgttccttcatagactgggaggcatttttatggcaacaccactatttcataaaagttccttggtgaggaaaaatgccactttttcttgtcaactagtttgggagctgggaattggagattgggctgtgacaatcagccttttcaagtttggacatactccagacacacaaaatccgttttgagggggacttacctgttttaagaaaattataaaagtaatgcatttttatggtaaaatttcaaacaatagaagagagagactgtgtaatttacttctctacttcagggagccactgacaactgtgaattgtcctctttttggcttattataatcctttttatgtcttcaatacttttagcctctcaaatgataacaagtacacgtgtgctgtctaatagttgggtgaatagattcatgtgtctgaagccatacaacactaacgacagctgggtcttgtcactccctgcccctgggctctgagtcacagcgcttggaactgcagatcctgcaaatttttgtacccatgtgcttggtttccttgtagctctcacagccagcattttgacattttgattaggttgagcaaggaagagaaactttagttatttatcacctttgttcatgtcagactttcctttaattattattttttaaatcctgttcttaaaatgtggagctgagatgtgattggtccaagtttgtggcagaagggcagagctatgtagaagacaaacaccaggtctgaagtgaggcgtcattgggccatcactcagccctaccgtgtatggcgtgggtttacctgaataaattacctaagctctgtgagcatctgtaactcagcaacaaagcacagagagcagtacatttcctgtttaggtcacagtgaaagccctatgagttaatggtgtgaaattgacttgtacattgcaaatcaccatgtgacccatgtatcacccaagtatcacccacgtgaccctcggttaacaatatcaagactctggcatgggctcccagcacgggaatccagggtgtcaactcctcttcatcttgacatagtctaagatgaaggttggctcagccattctcctttgcagccattaatcttgtcacaaccaccattatataagttatacaaataaaggcagacatttttccaattttatagatgaagacactgaggctcagagaggttgaatgacatgctgtagtgaattgcagcattgtgacctgaagccagcatgtccagtcatttctctgcctgctctcagagtcatcccttgactattggtgatctacactcatgtgtagtggtctatacttaggtgtgtacccttttccatcaccccattgtccctaaattctttgcatcctagcatctcaagaaatctgtccaaactactcttcctaagtccagccaagccttttacatccccagctcaatgagttttttgtctgtaatcttcctacctgaccgttttgcaacatgtgcctcgtaaggccactttcagaaacctattcctcaatttcaattcaacgtccagagaacttcatggacatctgctctgtattagggtcttaggacctggtgctgtgcaggaaagaaagataaacaatatttactctctaggctctgaattttcactatttcccagtctaatggaaaaagatacaagctgacagtaacacgatataacagacatccgctttccattgtctcctcctatccttcccattactgcctttgattcatcatggaagttttcctccttctcctgtccctgaagtccccaaaagggaacatcttcaagaatttaacattttcatggcaatcataatgatgatgatgataatgatcctcctccttatcatcattgtcacgtcattgtaacagatctattgagcacatattatgttctagacactgtgctaagcaatttacttgcatttatttcatttgaatcatgcagtaatttaataatgttgatacacttatctgcatttcccaaatggggaaaggccagttgatgctcccatgctcctaactgtattccagatgcttactcgtgggcctctgctggcttcatatgatctttgggatgtggttatctatgcctgcatgcagctaccttccatcttcatctctagtctggaccatttccccaatgttctcaaccaatctttacatcactttttctgtaaatatcaacttcattctccaaattgcttggtgatagatgttggaaactaggttctttctgactcttctttctttttttggagggggggacagaatctcaccctgtctcccaggctggagtgaagtggcacaatcttgggtcactgcaactttcacctcccgggttcaagcgattctcccacctcagcctcccaaatagctgagactataagtttgcaccaccatgcccagctaatttttgtatttttagtagagacagggtttcaccactttggccaggctggtcttgaactcctgatctccagggacctgccctcctcgcgctcccaaagtgctgggtttacagccatcagccaattctttctacaaagtggtttgcataattttcagggaccaactcaaataccagttcctcatgatcacaatcaccccagttgaaagagatccctccctcctctgcagttctgcagagcacattttgcatgacacttggagcttctaccaacttccataatgaatgccatatactatttgtgaacatttcttattatctttaatagatggtgtcttttcatttatgtccttatattaatgagaaagtacatactcaagtcctatgttgctttcaccctttagataataagaattattttcaaatcctagagtatctcctaggatgctcaggatgaatatcacaaagaagaaatacttccagaagagcaaggaaatagggagagaacagtagcagctaatgcaaagacaacaaatgatttacaacatgagaacaatctgaacacacttatggtttaacaaaatataaataaattcgtgagatactgagtgtggcaggcagccactgcaatggcccccagtaacccttgcctttagggaatgctggtatcgtgctttggtgcagatatgatatggagggtggagcagaggcttacgagacagaaggccagaagaccaagagctgaactcaggtctgctgtgtttcggatgccagtgggagaaagaggcagacctgagtgccagagccatctagaagaagcaatcaagagttaatacaatggttgagcatgagagaaggaattaagagaggaggcagcctagggatactgttcaggggacagggtaggtggcggtcccatcaattagaattaaagtggtgatgccagcaggcactgagggagacatgctatggagagagagccaggcttaacatatggcatctttttaaaacaggctcaaactagtttaggaatttacaggcttagcagtgatgtggggttgcatgcctttcccagagtttctaaaatcatgcctgacaagatggggactgactctcctaattcctataggcaaaatcaaggaggggataagtgtatgagaaattcatataaagctaccctaaagacatttttctacccatttggcagcaatattttcaccacaaatagaatgaagtgcataatactacctcaccttctgtttacactgggtaactccaaccgggttctttctatttaatcatggccctgtcccagtaaaaacacaccctatactacctctggccaccagcctacacagttctgatggctgcttcctcagggaggacttttaggggacaggtggctcttacaaagcaatcatgagctcaactcatcaatgggctggcagctgaggtggggaagtgatgcatccaaggcaaaaggtgtgacccaggggactttttgttaaaacaggtcgtctgccactatcctttcttcagaactggtaattgaaatgagcctattgactgatgtggtaataggccatggatgactattaaatgatttgcacatggtggctagtatctatggagctgttattacgtacctggcatggcaatggtgctttaatgcatttctctgacaaaaaaaggcataaagtaggtatcagaatttttacttaaggataaggaggaggcacagtggctcacacctgtaatcctagcactttgggaggtcaaggtgggcggatctcctgaggtcaagagtttgagacaagcctggccaacatggtgaaacccagtgtctattgaaaatacaaaaattatctagaagtggtggcgggcacctgtaatcgtagctacttgggaggctgaggcagaaaagttgcttgaacctgggaggttgaggttgcagtgagcccagatcacgccattgcactccagcctgggtgacagcaaaactctgtttccaaaaaaaaaaaaaaaaaagattaaggaaactaaggctaagacaaacgaaataactttctaaaatttgaagcccaggaccatcaggctcacagattatgctaactacttgctttattattcaggttattgtagttatattttatatccatgtttctgtcaaaggtttttggtgtggggtttcccagtggaaagggaaatgattatatatggtggagaataaatgagagagggcttggggaatggaagccacacctcacccacttggctcagaccacagggctactcctgttttgagaatttccagctaactgccttataaaattacatagcatggtatttatggtgctagagcaccaagaaaaattcaataaaatgatgaatttgacatctctgactcaatctcctcttccatatttttcaagaggttttatgattgcatatattaggggccagcaaaccttttctgtaaagggctagacagtaaatatttctaggcattgctggccatgtggcttctgttgcaactacttaattctgcagctatagtacagaagcagtcataaacaatacataaacaaatggccatggctttgttccaataaaaatttatttataaaactgggtggcaactggatttagccagcagtccatagttttctgacccctggcataaatttatgagacactgagtgtggcaggcagcctctacgattgctgccaaggattcctgtctttgtgaaatgctgtgattcatgctctggtgtaagccactccttttgattatgagctggcctcattcactcatttctaataaatagattataagtctatgaagcaatagattataacctaatctcagaagtcatgagagtaagctataaaaaggctgtgggttcagttttggatgccttctcactcttcttgcttttgtggaagcctgctgccatgttttgagtcgccctatggagagacctacaaggcaatgaactgaggggcttctctggccaacagctagtcagtcactaaggctcttaatataccagcccacagggaactaactccctccaataaccatgtgagtgagtttatggaagtagatccttccctgtgtaggcttcagatacaaatgcagccctggctgacagcttaactgtgacttcatgactgagcttgatctagaagcacccagctgggccatgcctagtttctacaatccacagaatgtgtgagataacaatgtttctcgtcttcatccactaagttttgggataatttgttatgcagcaatggataactaatatagtgaggtatagtgcaaagaatggaagagatttagagacctatgtttcagtcccagtttttttacaaatttgctatgtaaatttagactaactgttgaccaagtctagcccttccattttttattctgcctacaaaagggaaaggaatcatggatttctgaggtcattacaggtctaagtcttcatggttcattgaattgtcaagctgattcctgcatctaaaccagagtcttgaattggaagcccatgagtaaaatatagtccatcgaagtattttgatattaggtgtcaacatttaaaacactaaaaattttgcataaaaattcagttttctgacttcctcagaaaaattcaatgattaaaccaccagggcccacgtttctacatgtaacactgagatttatccaaaaatctcttgtcccgttacatcacaggtccccaacctctgggccatggaccagtacccgtccctggactgttaggaaccatgccacacagcatgaggtgggtgacaggcaagtgagcgaagcttcatctgtatttaaagctgctcctcatcacttgcattaccacctgagccccacctcctgtaagataagtggcagcattagattctcataggactgcaaaccctattgtgaactgtgcgtgccagggatctaggttgcatgtttcttataagaatctaatgcctgatgatctgtcactctctcctatcacccccagatagagctctttagttgcaggaaaacaagctcagggctcccactgattctacactatgataagttgtataattatttcactgtatgttacaatgtaataatagaaataaagtgcacaataaatgtaatgcacttgaatcattccaaaaccatctcccccaccttggtccatggaaaaattgtcttctacaaagctagtccctggtgccaaaaaggttggggacagcttccttacatagaatatgagtgctccaatgcactgcagtacccaattccttactatctctcactggcctggctctgatggtctttggagaaccacttgaatgatgcttattttgagatcttccctaaaacagagaaattatgttcttttaccatctgcttgtatcttgggtccaggacactggccaatttttatttcaatatggcctttgcgaagttctgtgatgtcataacatctagatccacaagtcccgctcacacaaacttcagggaaatcccagatcagagccacatattcttacattagaacattagagctcttatgttcttctctctcttcctcacatctagaatacatcttatccctccctctttacagaaaaagacacacacttctacatacacacacacatttctagtttcacaccattgtggttggtaaaacatacttcatatgatgttaatcttcttaaatttattaacttgttttgtggcctcacatgttatctactctggagaatattctacgtgcccttgagaagaacgtgtattcttctgttgaatagaatgttcagtatatgtctgtcaggtccatttggtctttagtgttgttcaagtccactgtttctttgttgtgtttctttctagatgacctatccaatgttgaaagtggggtgttgaagtctctgatattactgaattgctgttactcctttcagttctctaaatctttgctttatatatttataattgttttattttcttgatgaattgaccactttatcattatataataactttatttgtctcttgttacagcttttgacttaaagtctcttttatctgatgtaggaacagccactcttgctctttttggttaccacttccatggaatatttttcccatccctttactttcagcctgtgtgagtccttctagctaaagtgagtctcttgtagacagcatatagttggaccttgctttttgatacattcaaccactttacatgttttgattagaaaatttaatccatttacattcaaagtgataggtaatgacttactattgtcatgttgttaattgtttttctttagtgtttgtagttcctttgcttataaaatcaatgcactattttttttctctttgttaacttcagatctcagagtatatttaagaatatcacatctttgagcagttgcccattaattcaatctcaaaactgggcatcttctttaagtcatgctatgagttcctcatgccattctgtgcaatggcaaaccaaaaatgtgttttagtttttctcaaaaacacattgaaatctctttatctagtttttggagacggaagattataggagtggaaatcagtaccctcctgttctctattcctctctgatacaagcatgtgcacagaggtggtttttggcatttctccatttcctggggacagcttctttgaaaaggaagtctttttctctatttttatttccataaaggctactcagccaaataaatgaggtagctgtttctttccctaccctgcaatctatttgttcttttttcaaggttccaacttcttcttacctttttttccttttttccaggaagaaaaaaaatatttaatttgatcctaacttgaagaatccaggttcaacacctcctgagatacaaaaagagggtgacagtgtaccttaatgatccaagaaggcatgaggtggagcaggaaagaaatcaaatgctactttggtgaacaatgagatcctagctcttggggaagtgagaagcatctcagtaatcagggaaatatttctttcttcacttggggttgagactgtactgtcctcagaacctaacatttgtcctggggagttgtacagatgttctatctaacaggttcatgagctaagaaataagtttgtttgcactcaccctggtgggcatgcatggagacagcctgagggttcgaccagtacccagcagacaaggcattttagagaactcagcccctcaggcttaatgttctctggagcttgggtgtcactagatacccatgatattcctgctgcttttctcagtgactgctccagcctgtttaagcgaagggaaagaggtgctggaacaatcaagtggtgtcctcactgctggcaggtgggagggagggagtgaaggagagcagtgaagcaagactgcactcccaagcagtgaaggagagaacgagggtgaatgaaggaggaggacaacttggggtcaagagactgaggctggaacacgtaagagcccactggccttttaaaggacctaagcaaagaaacttcccttttggaatctgggaaaagcattaattttccagactttaatttgttgcccttctttgatgaaatctccagaaactttgataaaatgttctgtttgtactgcataggtctcgtacaaaagtgtaagggagtttgagggaacttttggtcaggggagggtgactgtggtccactgcaaccctcctgtgtgctcctggagagagggcatcatcttttacatggaggtgaccacagcagaagaccatgacccccagcagggcctcggttccaggcaacgctcacaacacataggaggacccagaaacactttgttcaggaagaaccacaactctgtacttcaagcaatggttctgagctctggatgcagaatgaacacaatgaggtatcttaataataacagctaaagatccaccccagacaaggaagtcacatcactgcaggaggtgccttggcataatatttagttttcaaaagcagctgagatggggatgagaaccagaggattagaggaagatgactccttaaggatgaggacactcatctggcttagagacacaacctggcctgtagctgataccgtctgcacctcaggctcctccctgtaaaacaactcagtgacaatggtaaactcaaatgtgaagcttttccagttcctttggttttgctcacctgtgacgtgcaccacacctagcatcgaacatcgcagctgaatattcagtcctgagtcaccgtgactctgccatcagctggtcaggcagatgagaattccaggaagcccgaggctggcgcatccccctgccgggaagggacctagcctttgccctgtctcgtggtgtgaatgtgcattcctggtgctgagattgcccagccacctttactcccagtcatgctagagtctgccaggctttcctcagctggaggaggacacgtgagtcttgtgggaggaattggatagaaagacacccccctttagaggaagaaggatggagaagcacaatgatgccgaaatgctgccttccaagacttcttcagctgtagcaactttccccacttccaggcactaccacatgcctggtcaatcctacagagaggctgagagtctctttgtcacctggtccccccattgctgcccctctacccggcctggcagctgatgcttccctccatgggctcccccacccaggatctaggcgctgagtcaactgggaggcaggaagggaggacagagtccctttgactctccccacattctggtggggctgatctgtcactcttccgggtgccagccactgggctagttcttaacttccttccttcatttcttccttccttcctcccactttcattcctccctccgtttcctccttctttccacaaacataggcatcgagctaaatattcaggaaaataaatggtgcacaggtcacaggctctgggtggcacaggagtctgtagaggacagcagacacaggaggcagttgcatggtgacagactccagctccaggtgggcccagcagtggaggagtcacaggagcggcagccagccacattcgggcctgagtgtcagcttcccggagaaagtgtagtcagagctgcaagctaaagggtgaacaggggaaaatgtgagcaatgccccaggtgtaggaaccagagggtacaaaactggaaaataaaaagcatgtgagttcaggaatttaaaataccttggggctggaagtggtggctcaacacctaaaaaaactagcagtgtgcaatggtgcatgccggtggtcccaggtatttgggaggctaaggtgggaggagcacttgagcccaggaggtagaggctgcaataagcggtaacagtgccactgcactccagcctgagcaacagagtgagtccctgtttcaaaaaacaacaacaagaaaaaatactttgggctggttggagatgaacaaggcagcagttctggctggggagtttagcgggggcttctgtacaaggggtcttggggaccctattgggaagtttggggctaaccaggaggacagtgagcagcttgtgatggggtttaggcagtcaatgcgggggtcagactaggcttcaggacagtcagcctggtacctagggaggcctgggagcaccaggctcagcgtcagggaggctcttgacctccttcctgtctggtgcccatcgcccctttacgggccacctggctttggtttggatgtctccgtcttgcttttagaccaaaaccggtggctgaatccatgcccagggcctgggacctggctttgctctctgctggcctccctgtgcttgctcatcgagtctttcccacttgtcattttcagtttccatgctgtacccaggatcctaccataggaaggaagccagttcgctctgctacattgaatttatgcttctctcttgcttttctgcaccatgcagacccactcggggaccaggggagcctcctgtagtgatgggtctcatgtctgagcctgacccttctctctccctgcagccctgcattggagtcccaggacacgagaagctggcaattcaaggcctgacaacaggcttaagccagtgtctagaggcatggaactgtgcctctagttccatttatatttttgagtgggaaatatgaacagtggattcaaacctctccttggaagttcaaatgacaggaggagaagcctgctatgctaacatggatcaaagggatggagacttttgagtgtaaaatcatccaccggcttctcccaatacccactgctgggacagacacaaatctccctccttccaggaccatcttgccaggctcctgtctgcttccttctcctgagacagggcaggggtcccttatctcttagtcttgaggtgagctgtgaaataccttgagatggcttcccagagtggcatggagcaaagctcacaagtcattttccaccctgcccaaatccaggaacacatgcatttggcagaaaccccaactcctttcacacattcccaccacagtgagaataggagactccgcccctttcttccactttaccagctgtgtgctcttgggcaagtttcttaacttgggtgagtttccacttcttcatgtccaagtaataataaccacttcattgcagatcaagtgtaaaacataaaaagcaattcttaatgcatggtcttctgttatccttgttatgaccacagtgattgtcacaagcactatttattaagagagggagagctagaagtgacgttgtgggtgaacagcatgtctcctatattctacggcataggaaccatgtggcataagggaaagtgcaccaggttgggggcccatcagtttccaccattaacttgcttcatgcagacatgcctcttgaaccttaaaatagacatggtaaaagtctgctggctcctggctgtgtggctctgggtaagtgagttcacatttctgagtcttaagtatctcatctgcagtgtaggcatattcatgccactccatagatgacctgggatcaatgcatgggcggtgctcggcacagaagctggagtggagaaagcattcagtaagctccaacgagctgggagaggtggtgttgctaggtctacctgcaggaggtgcttgggcccctgggagtttagcaacagagttcttctatacctgtatgctggacagatctggtctgagctctgcatctgcctgggccttgtctgtgccggtgcttgtgtcccatcccaggggcctccctctgggtaaccacagtgaccacgaagcccttgctagcctgtctatagggtgggctactcctttgtgtgcattctcagatttagtcaggacaggcacatgtttccctgcaggcgagacctgtgactaagcttccagtggagtcacctgtagaacaacctgcaggtgatctaacacacccgtggcatcccatggggaggaatcctggaaacagcttgaacctctggcatcctgccatcccgaggaccatcaggattttagagatgccatttatggtcttctgagtgtggcggacccttgcttctctgcagagtgagggaggaagccgaggaccctgggtgaatttcttttataattttgggtgaatttcttaattcattccgaacagatgacattatttgtgtgcatagaggggtatgtggaaggcaattccaaaagaggaattttagtattctgaggtattgcagtgttattgttaaagcacatagcctatggtactgcaagagtaggattttgaaaggttttcttctttgttttgttaaaaatccatcttatccctttattgttgcagtaggttaacagacagccattttcagttggttgataatcagcctgggagagctatgctgcccgtctctgcctcatgtgaggaaggataggggcttggaggagtttcggtgggatggacctgctcatatcgcccagcaaggattgtcatgggggtgggatttggtgataataaatcaccttcggagatgggtggcaggacaagagcctcacctttctgtgacgattatttgcatcaagtgttccaagaggtggcaagacagacctgactgccttgatctgaagagcccagaccaactctaaaaggtttagactttgagcttgtgtgggagattggctcatgcatgggtggtttaaaaatccattctaggccggtcgcggtgggtgatgcctgtaatcccagcactttgggaggccaaggagggtggatcacctgaggtcaggagttcgagaccagctggccaacatggtgaaaccccgtctctactaaaaatataaaaactagccaggttcaggtgtgcacatctgtaattccagctatttgggaaggttgaggcaggagtatcccttgaacctgggaggcggaggttgcggtgagccaagattgcaccactgcactccagcctgggtgatggagtgagactcagtctaaaaaaaaaaaaaaaaatccattctggctataattgcatagtgagacactatgtgtaaattatacatgtatctgcatgtgtgtgttttagtcactaaattactccacctgtatgatgttaaaatgcaatatgtattctttccaggttgacaactatctcaaatcacatttgctgtatcttatttgaatcaagaagattcaattattagttaataaaatgaatcacctgtacagtcccaatactgtatggttcataggaatttcatgtaatctttgttttcaaaatcaaagagcaaacaacgtgtgttcaaattatcaaggaagggccaaagctcagtgaggtcaaggacggcagacataggacaaggacgcaggcattttcattcctagttcagggctttttccaggatgccatgaggctcattggggcatggcttcaatttagtgacatcctgggtcccttttctgtctatgattccatgagggagggacagaaggtgcacatgtcatgctgtcagaggcagatgctcagtgtggagactcaggggccaggggacttttcacttctccagccccaacacgtcgagcctccctgttagctctgccgcctcccgtggggtaagtgttaagcccctgaaaatgaaggggttacaagttctgttgtgaggccctataataaaggagagctaataaaggcttcgccccaccttctgaccggattgtagagatgagtaccccaatgggacggggagtggttggaatgaggagaggaagaaggcggtgaaaccaggggattgtgagagataagacaaggatgcgggcttcaggctgtgactaggatgtggccgcgatcacagtggggtttcccagcatcccctggtgaaatctgccccagtgcttggattaaaaaggacagtagtggtgcactgaagaagaccagtggttgaggcttaggttaattcactcattccttcctctatttcatatttattgttcttcagtggttactaaagatgtaaatatgagtatttatgtaccaggccctgtccttgaggagctcaaggtctagtgggaggactataaatatgtaaataaatgatggcaacagagtgacaagaccctatgataggatgcaccgaagtgtctgaggggcagagacgtagagcaattgataatgccaggcaggaatgcggggagagggccaggaaagcttcagagtggggttgaaatttgagccaatttgagtactaggagggaacagctctgtcattcctggttactgtgtcatctcaggaagctgattccttagagatacagtggagatgatcacacttatctcagaagaaagagctatgtgaaaagtatgaggatttgccaagaaaaacatcctgggcccccattggaccaggcctagtccttctgcccctgctggctggctggagctccggcccatcaccaggcaccctcctgcccctcttagggttggcagagggttcacgcacctctgagtgccagccagagaagcaacttgcgatgtcctgggtctcccagcacctcttcccagcttcccctgaccacaggctgaaggtgtcttagcaaggacaaggcagatgaatcctcaagttgaaaacagatctggacggagggcaggatggggtggacataatcactacttttatttgtcctcgcactgaggatcatactccggtctctcacatggatccctggggagccagtccatggagcacagccgagaggcagtccaggcttagtcagagccacagaccctgggtgaggctcctgctcttcggctgcagagagctgcctcctggcctctgaagccgatccacctgggccaccctgaggtcacaactccagaagacaggaggcaggaagaggaagtctctactctccttatccacagcgttgtctgtgctgctggcctgtccctgttcccaaataagagcagatgcctgacaatgcctcaataaatatccctgctgattcagtctgaacttaattcatttccgcacccccggcgtgaatggtaccctgtgcagggcagagacgaatgaggcactgtaatcagtgccaagagattcaggccagaagctttggtaacctgggccccctggctctcccctgcggtgaccccagctgctcctgtccttagcccagtgcccagcttcagaacaagtggtcaaaaaaaaaaaaaaaaaaaaaaaaaaaaaatcccatctgcaggcgccggaagggcagcgcgccctcgcgtggtaggtgttggtattgccgggatgcctgcctgacccaagcctttcaggctttgaaaaagagcgttttggggattctgtcttagaaccacgccaggacattttaggactgagttcaatcctgtcactttacagatggggacagggatgctatggagatctgcccaatatcccagaggggcggaacaagaaagtaagccccagttttgggggctctcacttggtctctgggctgatccagtcagattcattctcaggccttacagagacactttacattgaaaaaaagaaaaagaaaaaacagccaaaaagtaaacaaaaattaaaaagggaacagagcaactccagagctcaccactgaggactccaggagcctgcaccgccttccctcccgtcccttcccttcccctctcctccccttcccttcccttcccttccatgtttgcttcccggaagcctcagcaaacactcccagacagcctgttttgtgctgggcaacgccataggtactagttttttaccatgccttacaggtggacaaacacttcctttggagaaattttacataagagggagatgacattttccacaatttagatcagcccaggcccagggtccaccttaaaaatattaaataatacagcctagggcccacgcgagtgccctgctggccggccctggactctgcagagggctccctgggggttctcacctgcagcaccctggcagggagggacggggttcccatcctccccatctcacctggtggagaccccttggtccttgggtgaggctctgcttccacacccccaggctgctgtgctctgatggagtctgagatcgagcccacctccttcatttcatttctgaggaacatgaggccaaaagaaggtgctgctgtctaacggcacctgcccagaagtcccatccttatggaaccaggctccagccccccagtggcccttcatgttattttgtgtttctggtacacagatctgctggtgtgggttggtggcactcctggctgagaacgtgtctgccagttctgaggcatgcacgtttgctgcgtttcactctgagccaaggctaataggggccaatgcccttcaggaagtcattcccttcagggatggaacaatggctctcccctctagaggcatgacagagagccctgcagaggtgcctgtgcctaagagagacttactctgtgcacttccagaggtctgtctgattgcatttagaaaagaaaaaaaacaagagtgagtttagaagaggttgcgagaggccaaaggcaagatgacaaatattcattgcaacttgagctgggaattgagactgtagccccaaagtgtacattctagtgggctctttacagcacctcagctcattcagaagcacactggactcaggcagcgacagaaacaggaacacagagcatcttcccaagccacctgtcagtcaggaaaaagcttggcatgtggtctctatctctcagcacgtttgtttttattattttttaaattccttacttgtaattggtgttcactactattggaattagtattcaacaaattcaagcaggatccagagaaaggcaaaaggcagctaagcattcaggaatctccatgaacaggggccctgccttgctccaattgcacagaaatatgttttttagaaggatcatagaagaatgaatgctgactgataggcatactgagaatgccatttatgaattgctagcctgggggaaatgtgcttcacctgatgattttcatttttctttcattcctaaaatggacctgcttaccccctattatacacactatcagcttgttgtattaataaattgaaatagcgtaagagtaaatgcttgaaaacaacactatcctactgaaatgtgacctgttggtgttattgcttgaggaggcataaagggaaaagggataaggtgcattaccatctgggtgaataagcaggagaaggctagtgctgggtgtggtaagaaagatgtcatcagaaggaaaacagagcagcagattggttgcatttatgtctctctgaaaatcagtttggagctcggtttctagtcagttcccatctccagatacttaagagatattcccttgactaggaaaggaaagtggaatatcacaaaattctgagacccctttgaaaaggcagtacatggagaagtaaggaagttaaaaaaatgtcttttatcagctcttcacctttggtgctaaattcattcaacaaatatttattgaacacctactataagccacacattcctttaagcccttgggatacttcaacatccctgccttccgggagcttatattttagatcccagatctgccatccatctctggtttctcttttccttcttcatctgtatttgatacgcaacacctattccagggatcagagcaaatgtcacgctttttctcaccagaatggcagaaaaaaagtctgcagatcccttgctgcatatggcagatggtatttctaattcccggtggaacatcccctatggatacaacagaagagagttgacatttaactcatatagtgcagagaatagaagatgaccccagcccgctgccaagggttatatattctgacaaggctaagtacttttggacaagccccagtttaaccgaactttggcctcttagctttaaaacaggaacgataatttatatctgaaatgttgccaggaggatgatagggtgtgttttatgaatgctcacctggcccatctaggccctaaaaagtccacacagatcctaaatgagggtcctcgagcctcccggtgagagatgtgcactagaaggaaacaaagggagttttggaaaacagaagtggtccagaataggacaggtcttggtctctaaggaaattaaaggtattaacccattctcaacttatggcccaatttttagttttatgtcctacaacgaaaaggagaaaataaaacctctctcctcaccaggacctgtgggcttgtaagtcacaaatgaccacctaaatttttataacaacaggacattgggcaagagatggttgaaagaaagatcttacttatgtcagatctgcaaatgctacgtacgatgactttaaacagcagcaacaacagcagcaacaacaacagcacagtgttggtcttgcgtgattaggaaaacactcttgcacaacatccaacctccaaacggggtctaatccctgattctgtatcatctcagccctgtcacagcttggaggagacagcaaagtgaagaaggtggggggtccacctttagtcaagacagaagagcccccagcctggaagcgtggagacctggattctggtcttacttcttccaatatctcattatgtctccttagacaactcatttaactggttacacttcagcttgcccatctgtaaaatgtgttctatgtgcaagcagggggaatattataagtttgaagacctactatgaccataaagattcattgcaccatggtaaattaacactttctctggactttggttttctttttgtagagcatggggctgctatagacaatctctgattcccttccagctctgacattcatatgactataacttccttctgaaaacttttctcagactgcagtgagtgcttgccacttgtatcagagcaagcatacccctttgtcttgtgtcaagacctttataacacttatttagcttttaaaaaacttcacaggggagatcaaaattgtccaagactgagccccacagtggcccacctgcatccactaacaacatacagacacatctacacactgtccatacagacacacacataaatggaattcctgcactaccttccccagggctaaccaggagacatttacctgagtttgtttggaccaaacaaaagagaacagcaaacagaaaaaagaccttcatgttttaaggtccgttgaacctccctgccctcccgtgaaggagcacaaatatgatgaatgatggaatgaaatggagcggagaaggcacaaaatgggacatttataggtttttgggaatactgatcagcatgagcatatttatctgctctactgagtaaggctgtgggcagaaggttactgactactcttccctttctgcctaaaaatagactggcttcctgatattcagagaagcagggatcaaccaataattccatatacggatattgaagaggaaagtgaaccaacattgaggtgtggctacttagtgccaagccctgtgctaggtgctagagacatggttgtgtaaagatatattttctgccttcagaaagctgcggtgtccaccacagttgagcagataattagcttatttcccagcaacatgactcccatctaccaacagaaacataggcccacgtgcattaggagacatgtgcacgaacgttcattgtagcacatttccttgcagccaagagaatgcaaccaaatagtgtattatgacaacaacaaaacacaatgtatttccacaccacaacaagaatagaaaaacaagaagatgtgtacaacaacgtggatgaacctcacaaacgctatgctgaaagaaaaaaaaaaacagagacaacgtaccacattattccaaaaatttggcaaaattcacctatttatgaagagccaggatattgtctactttggaggaagaggacatgctcttctctcatttgatgaagttatccgctgtcggaggtgacagtctagtgagggatgcagagagcccccggcaaccacagggctgtgtcatcctgggctggagggaggtttgtgggctctggggtgctgggagttgtgaaaacagaatctgcaaggacacgatatttttgtgtgtgggtttatataatgtgtggtattaaaacacacagtggataaatctgcacattttgcccctatttgattttagtcccaggatcacttagatttatttcccttaaaattctcttaagcaaaaggggcaagtgagaaggatgtcttctctcctatccccctgggcttcataacaattgctgttagcttcttattaatccttccagaggtgtcccatgtgtatggaagcagagatgaatccataccccatttttatgtaagcaatagcagactctagatatcattctggacttgcctatattacttgttatagcttgcagagccttgttattcttcagattagacacatcatattttcttcaagctgtcttctgcgttatttaaccagtctacaacaaccatatctcaccatgagtcttacctagacatggattttgaaaaagagacatcaagcagtggtcttggactttctgcatgggtgaacagtgtgagcatctcaaagaggcaggggctgggtgttcattttgaactttccacctctggagagattaagcaggacaatgtgccctggcagggactctctgactcacagacctttctgtaccttgcaaaatcacctttgaagttaagactttagggaaaattgggcactccaagctgcttttgaccctccaccaaaaaaaaagagagaaaaaaaaaagttaccttaaatgttagctatgtactaagtaattgtaaaatagttatgaatatttgtgagggtccaactcagtactttaagaaatcgattaaaatgtgaaattctttctctgtggagcatttgttctgaagacatctctgaaatctctcaaaaaaaaaaaaaaaaagaaagaaagaaagaaaagcaatttcatttgccccttagggaaattggcttccacaccaagatgataccctaagttcaagggtcccaaggaataatgacaattctgaatgtatcctgtgcatggacaaagtggctgtacgatacatgaaccattgtttgataaaaacactgagtgtggatattcaaaaatttgagtcattttttaaaagtcactaagatgacttatagataaaacaataaaatgcatattttatactttacattcattctttctatttatactacacgttatttggaaaggatccaaggtaaatgtggatggcatattttttctagcagtacagttactaatcaaatcattgtgaaattatagtttagaaaatttctgtatagtttggaaacaataaactatgttggaaaataaattcatttgggggagaaataaattaatagtattaaattttatcatgtaccttctcctccagacttgaatccatttccaaatcacagacccagaaagcaatccccacggaactattttgtggataattctgaagaataaggcatatcatttcaaagaaatcaaactagaaaatcacgcttattggctaattttgttaatatctggttataggttcataggttcatataattgcagagttgaaaggaaatagagttcaatttgtgccaacacacaagctaattattctgatgtgcatcatactcatgaatggaaaagaagagtgtaaggagaagagaggaaagataactttgggtttgcaaacatttgatagtagaaaaaatgtttctatattttaaaaaatattgatacaattcaacaacaaaaagacaaacaacacacttaaaaatggacaaaggacttaaatagatttttccaaagaagaaattcaaatgaccagcaagcacacgaaagatgctcaatatcattagtcattagaaacatgcaaatcaaaaccacaatgaaatatcacttcacatctactaggacagtcataaaaaaaataaaacttcagaagcagtggctcacacctgtaatcccagcactttgggaggccaaggcgggtggatcacaaggtcaggagttcgagaccagcctggccaatatggtgaaaccccatctctactaaaaatacaaaaattagccgggcaattagctaggcatgctggtgggtgcctgtaatcccagctactcaggaggctgaggcaggagaatcgcttgaacccgggaggcggaagttgcagtgagctgagatcgggccactgcactccagcctgggcgccagagcgagactctgtctcaaaatgaaacaaaacaaaacaaaatttttgaaaacagcaagtgttggtgagaatgtggagacattgtaaccttcatatgttgctgctgggaatgtacagtggtgcagctgctgtggaaaagtctggcagttcctcagaaagttaaacaatatgagttaccaatatggcctagcaattcaactcctaggtgtatacatacaagcggtgaaaataggtgttcaaacagcaacctgtacatgagtgtagtgttcatagcagaattagtcacaagtgtcaacggtggaagcaatgcaaatgtgcatcagttgatgaatgtataagcaaagtgtggcgcatccatacaatgcaatattatttagtcacaaaaggaaaagaagtaatgccacattctccaacatggaggaactttgaaaatctcacattaagtaaaataagctaggcacaaaataccacatattgtatgattccatatatatgaaatgtgcacagctggcaaatccagtggctgcttactggtgtctccttttgggatgatgaaaaagtcagctggggtttctccccacttttttatcctcatggacaatgctaatgttactcctcttgctccggaggttttatttatttatgtattttgggttttcaagaaagaggcagggtttgtgttcatgaatttaatctctctttatgaaggcatactaactttccattttggtcttattatttatttccattttggtcttatcaactaagggagattccctgggtgcagaaggtcatttcccatgacccaaagaggtaaaaataagccaggtgagagcaggtcaagcctgcagagttgcggtgacgaccacatgtagggacaggaagaaaagattagaagcgcccattatttatgtcacacgaggtgcaatggggtggaattgactgagcctgcccacctgttccttgccccgcaaacctcaggcattgaagagaagacaggcttcctgatgatggggactctctgagcaatggatgagtcagaaggatcaaatcccgggaaaagctgctggggtgcaggggagggaaggatgctgcgcggaaggtgggcgtgcagagtggaatacaaggcagtcaggtgtgctgcagtgcgttctgagacagcctccagcaagcttctgtctaaggacctcttcccactgcgtaaaactggtggccataaaacctcatcagggctcaggggcctgtactaaaaagctgctgtgagaacaaagaatgcataactaacggaattggtggctcaggactgaccttgagaacccattatatttattcagttgtctccaagcaggatggcacatttgtttttttaacgtctgtaatttttatttatttttattttattttactttaagttctgggatacatgtgcagaacgtgcaggtttgttacatagatatgcatgtgccatggtggttttctgcacccatcaacccgtcatctatattctaagccccacatacattaagtatttgtcctaatgctctccctccccttgtccacaacccagcactgcaaatattataatatcaaagaatgagaggaaaaaaaaatcagtttctacctgttttttatgaatcccaggtaggctccaaagtctccctgggtaacatgctttaaatgtcatatcatctttttataaaatttttatttatttttactcaccgctatgcaaacaaggagtcttatcatcttactgcccaggaagcgctttcttatgttaactctgtgagtttctggatgcaacttaagtctacaacagaatgtctttgcttataattaagtgatatctttgtatatacatatatatgtttatttttaggcacattaattttgttcttacaaatgtatatttaacatttaagagtaatgcaataacttgatggtatttttaaaggtgcaaatatctaaaaatcaccaataattttaacattagaaactttattgtttttaagcatacttttcacagttaattttatatcaaatatgtgaacattggtatcataatttttaggacatgtaagtattttgaaaatgttatgcattttgatggtttttcactgtgttatatttattatacctaaggaatatgtaatatctctgagtagatttattgtagtttgctaatatagtgctccattttgaactttttagagttttttttggtttctcaaagtatttttttatttcccaggataatttctgagcagaataactgaaacaatgagaacgagtattttatatcttacatacatattaagattgctttacaaagaggttatttaagttaccagtgcttctggttttgtatgtgaggactagtttcatataccttcattatccgtgggtatcagccccgtgtgagtgtgcccatacataagttgattaaggaacatctttgttcagaaaaaaagcctggaaaggtggcattctgtaaagggctctgtgtacctagtttctttcctatgctgagccccaggatcctgattcttacccagatgcttatatttaggttggtgcaaaagtaattgcggttttgaccgttattttcaatggcaaaaaccacaattacttttgtagcaatctaatacataacaatatttgcaggaagttttaatttatggggattaaagaaagctgcaaagagaataatgagctcaaagttttgtgatgtgcagtttattattaattaacttgagcctaaaataatgatcactgatgaagattttatggacagattaggcaaatatcattatttcttccctatttatttattaaagacatccatgaaacttcttttaagtagagataccctacagaaaagtttaagacaaacagcagattctacccacattcactctttgccacctctcactcgcttgcttaccctaccaaagcaatcctgcacagctggtctgcatgagcaagcagatgttagcggtcagtgtaaaactagcagaagtgaagtcagcacttttagaaactggaagagacttaactgaactggaatatgtgcgatttcaatggaaaaatgcagttttaaaacaatcaatatgtatttattcctaatgagatttgagaaactgtggtcagcaaaatgagaattagatcccatgagaaagtcacacgttgagaaagaaagggactatttgcaaatataagactatttaaaaataattaaaaatctaataactgaacttcaaaatccaaaaatagtaaaaaaaaaaaaaaaaaatagaagggctctacagatataaaaataaatatctgcaaagtagagaacaaaagggaaaagcatgaaaattatggttgaaagataatgagaggatatttcaaggataactggggtttaagcaggaggcattccagagaaagggaagataattgatggaggaaagaatatgtaaggttagatataaaaggagcacatgtacatggataagaataaagcggtaacctggccgggcgcggtggctcacgcctgtaattccagcacttcgggaggccgacgcggacagatcacctgaggtcgggagtttgagaccagcctgatcaacatggagaaacctcgtctctactaaaaatacaaaattagccgggcatggtggtagacacctgtaatcccagctacttaggaaggctgaggcaggagaattgcttgaacctgggagaatcgcttgaacccgggaggtggaggtggtggtgagccaaaatcgcaccattgcactccagcctgggcaacaagggtgaaactctgtctcaaaaaaaaaaaaaaaaaagagaataaagtagtaacccagtaaaactattaaattttacagaagagaaaaaatgatcaataaacaaaagaaaaaacgctcaactacacagtaatcaagggtgtgccagactgatatctgcaagatggtggactaagaggctccagcctttccttccttccacggatataccaaagaaatatcaacacacagatcggttctttctgagagaaaaccatggactaattgaaagactactacacatcaagcaactgagaaaatattcatgtgaaaacaggtgggaagagctgagacacactccccgcacaatccctatcccagacataacaccttacaattaattggtaaggaagtcccaactcctagcttctccctgaggagtgaagggtttggaccacacatatagtaccctgacctttatgcttcccacccaggggtttggctcctaaatcacccagctcagggttgatagagctgggcatctgcaggtctccctaaaccacagacaccaaagagatggtgggacacagatttgcaagcacttttggcagctctctccctgggctcaggccagagcaggcaggtaaatgcccacctcccggtttctacctgcaaggggtttatctacccattttcccatctgctgcctgagggttgacttctgggtctgtatctgggagccaaaggggcagggtgaacagtagacctgtgggagcctgaacagaggtataggtaggcactgcacctgctcctctcgactagctccagcaagaaatccaggtctccagcttctcccttgaaggagaatacttcaagcacagttttatagctgccacctgggggactggctcctaaatcacttatctctagaagttaatgtgaggcaggagaattgcagaggaaattggaagttggataaaggatagagtgaataaaagcagaaacagaagcaaggtgaaggggtgggtgagcaagaagcaagataaaaggcagaagtgaagcagccaaaagaaaaagtgagataaagaagagagcaaggaccccatggccagcaagatccagatcaaaccaggaaggggcagctcttcagagataggcatgcgcattaaagagaaaaagtatccttaacaggatgctgtatgataatcagctcattaaagctcatgcatatggactacctatcacgcatgtagttaaaattatgggatggagacaattcacaagcccgcacaggctaaagtaactaagcaacacacctatctatcaaaaggcaggcaccggcaaaagatcaggcagccttgcgaagagaaggggaaaaaacacataaaaagacccaaggtacaccgaagccatgctaatctcatttggcagaagtcagcccactctcccctctccgggaatgtaatactgcgcttcacacacttttgctgcttgctttgctgtctgagtatcacatccagttctttgttcaggacaccaaaagcctggaattgcacagcaccatcgggttataaatgggtctctgcattttgtgtcttctaaggccacagagaacaaatgggtagttttaaaggggcacaagaggacttccagagggtattcttccaggtttagcacaaagagaacaggcagtaactcccagctctcagtatctccccagaaggcatttgcctgcacactctctcagctgctgctagagaacagggcttcgaactggcctgcaggtaggagatgatggggctgatggagaatgggtttgaccacacacctgacacctcaactacatttcacagtacttagaatagaatggactccattgcacagtacctagaatagaagtaggtattcaaaaaatagtttttaaataaaagaacaaattattttaattctttctaataaaagtttatgatatccacatttactagcacaaattgtgtgattttgaaaattctgttcatgtcaagctaagtcatcttctgtaagatcacaggtagcatttttgtcatttatcttgccacaataaaatatttgaactgtctggcacaagtggcaatatctccgctccctgctgctcagacacttccgcaaaaaacctgcacctgattggacaacgtggccccggagaacaggtaagtggcagagctttgtttctatatcagcaacatcagttttaatgtaaacagcaggcgtctttctttttagagcagtagcctacttgtgtttccatataattacagtattcttggcagaagccttcacttctcctgcagtcaacaacttttaaatctgatgcaggttctgcattaaaaaaagaaaaaatccaacattagcttcttaagaccatctccagaatcaaacagtggtcatttgagccgtgagggacagggtgggggtggcatggatatgaaacagctttccatagttaatagcttcaagttccaaactaaaacatcaactccagatatatagctctgccccactaaatctcctttaaccaaaggaaggaataatcctgtctcacaggaatactgttagactaaataacacacgcctactattgcacctgtttatatttgttgtgtaataattgagttttctttttcccttcccttgggaggagatccagatgaatgagtcctttggaactgtgggccaattagaaagggatgggaggttgggtaggatgctgcaggcatcaaattcagcaggactttatttgctggatgtcacagcaatttgccaacaccctcctgtctttcttgctcttgcccactgatctgctaacctagttctccctgtcttagggtcagcaatcagcttggcattaaagaagcatcttggaaactacaggctcttccaggcccttttggatttgaagctggtcctgcccaggggtttgggggctgaccagaagcctggcccttctggaagagtccagaagagtggctgtgggctcaattgtcccttgccatgtcctgctacctccttgcctgagtagactgacaatacagtctattctctgcccccattctcaggaagcatttcccagacctcaatggacacctgaaacttagtaggtaggtattcagtaaattccttgaacgggaacgacctccaaagctaagggcatggggctgcaacctggcaggaggccatgtttccaccagtgtctcctctggcacctgttcttggaggaagccagcaattacaggtgtggcttcagataaattgccttttggcccctcaatactcccacgttccacaaggccctcaatgatccagccccaggggaagctgtgagaccccgtggtctccctgacaggcagggcagcccaatgcacccgcaccatgtcttccccaaacaatgactgctcacccaccccgaccagcacagacatcttcccgtctatttgttccctctacgtctccccagtggatgcacttgttgcacgtgttggtccctgactcaccttggtaaggtggggtgcgcggtggtaagaggtcccgtttcactgcgtggcgtagcagctgaaacccgtttgtgccttgcccaggggctctttccctgagttctccgagagcctcagtggctgagtggttcacatgtctggcttgagacgatcctgtgcaagtggaaacacacgtctgaggatgctctgaggcctccgcctggcagacccgtcagcatgaggcacctacactctaccaggtgagtgagcatgggtgattgggtgggggagttgggaggggtgctagtgttccgtgtgtgtgcacgtttgtgcacatgcgttgtatgcacctatgtgtagagagagaaggtgaatgaagtgtaagaaatgtatgccatgaatggtgagtctgagcacctcctcaaagccagcacagccagagaatttatttcaagtgtcactaatgcagttgttaagattccctaaaatgtaatgttcttctctgtaagggaaaggggaatgttaaaaggataagaaaatggagtcggggagggacactcttccctgggaagcaagtgccatcagccaattcagagtgccatttatgaacccagttcagagactcgtacccaaagctccaccaggaatacatgccccaaggacttcatctctccctgtccagcctggactcccatacctcagatgaccattgcagagagattctggcacccagacccgggtcacctttccattttacctggaaacagcagggccacaaggagaaggctggtgacggacgggagcaatcgttgcctcatgtctgccaagagcactgcaagccagaaagcacccagggtgggtgggcaggcagcggggctcctttgatggagtgaggctgggtgtgtgggcccggagcgtgggaagagctgtgctccaggatgacttctcattctcaaaggacaatgtggacacgctactatcccactgctggtggaacaaacacttgagacacatatttcaggaagtaaataatacgcctgaatgccttgggtgggtttggtgaataaggaagaacagagagaaacagaaagatgaaaggcatggaggggcagaacaaacataactatcataaagttgccaatgtcctcaaacgcttctcaaaagccccctaatgttcatgagaacagggacataaataaactgccatgtcgattctatcctgttggctgagcgtttttattttagtgttaaaaaatcatgcataagacacacaacataacaggtaggacctggttttacaaactatcccttcctgaagttatacagagagttccaaggctgctcaaaatgttcttttctttttcttctcctctctgagtctctctccctgtttcttggtcccctccacttctccttcctcactttggacccccctcctttctattttaacttatttgagttgtcttgatttttctctcccctttccattctctttacccccagacacctcctgttgatgtcactgggtccaattcaattcttttaaaaaagaaaaaaaaaatctgtgtttgagtctgggttttctcctctagtaatatccaagcagaggacttgtcttcccttctccttcatctttttaagcattttaaccaagtgtgtgtttcttacttggctgcattagctcaggtatgcatgtaacccagacagtctgctctggacttaactaaagtgaagaaggctttggttgaagagttttgtattcacatagcatccaatgtaacatcagtgatgtctggaaaagatagtgcttatctcatatgtctcatttgcatgtatattttaatccagacagagaaaacaacttaggtcatttgtgtaaataaaaatacttactctctacctggagaaagctggaagcaaatggagaaagaggcagcaatgacaatagagacctgggcatccgctgaagcaccagcaaagggcggaaggtttgcagctgcggacagttgcacatagcagctgccctggcagcacaatgcggaggccactatcttttgggtctcaggacagattctccactgcaaagcatgaggtgctggtcagggagagcaggagcatcattcacatcctttcactttaaggaattaggaagtcttccaattccaagagcacagggcaacactgcggagataggtgacaactggcccatgataagtttctttaatcacttactgcatcaaattctgataattggatgttggaagaacatagacagtcaagaaaggaggtagacagctgctctacctcaaccctaaatgaagatttattcgctcatctacatactctgggtattttttgtactctagttcaatagcaacttcttacagttgtatttgtaattatttaaacttggaatgtggatcttttataacagtgatggaaattttggagtatattggtaacttatttctatatatttttatcttctctataaaaggaaagaaaacaaaaacaagcctattccaccattcagatattaatagtaatgaatcattaatcaaaatcatgacttaaaatataacagcatttgagtaattaccacccaggtaacggaatcttctttgaagtcgttagaattatttgaaattatttaaatgaagaaactgagccaaaaatagttagatctcacttcctttgtctacgtcttgagataaagtaagccccctcttccatgcttctgaaaagaacaatcttaaaaaagagcagccgggaaagcctagttctgctctttgacaggcaaaagctggtgaagtcgtaataaaggcaattaatgttacatctgtcctaacacaacaatgctctcagctcctgtcctcttctgccagatttctgtgtcctaaaaaaatctttgaataattctcttgctaaaagccacatccatcctgagggggaggatggcagaacccattatagaatattctaataattgtttcaagttttttttggtccattcaatcaataaatcatattcttttttttttaagctgcttagtatgtggtatcttgattcgtttggactaagtaggtgggctaaagtaaaatgatcaagattttattgtcaaataagaagttctgcaaatacatattcctgaaggatcttattggaaattgcacacatgtgcagggggtaagattttccacatcggcacatcctccttcttgcttcccaagtagcatcctggtaaatcctggaaaatatgaatgcgagaaggaaaaccctattgtagcccagtttggaatcagaagttctctgcagaatcaaatttagactcttcttttgcattactaaatgacccagtgaaagtttctctggaggagactcacagaagagcgaagcaaagattcctatgcagattttcttattcttaagtctgagattgtaacatgctaaccagtctgtaagaccaactagaatgccatttaacagaggcacagattcccctctagggaaaataactgatatatggaaaagacacaaatattagagtcttctttggaaaaagcagtcaggaagaattacatgataggagagaaaactgcttttggatcgtggttaaagaagtagctttgagaattgtgcaaaaatattctttggtattttgtttctttttcatgcacagaatcacaaaatgaattgtgttttcagaagtcgatttgatctgtagccatttcagccatcccaagaatgctcttaaggcagcatatgaaagaacacaggaaatcctttcatgagcgctaaggcataaacaccatttagttttggcaataaaaacatggtattgttataagtttaaataaatctgttgagattgcctattctttttcttgagacggagtctggcatagttgcccaagctggagtgcagcggcgccatctcagctcactgcaacctccgcctcccgggttcaagcgactctcctgcctcagcctcctgagtagctgggattacaggtgcctgccaccgcgcccagctaatttttgtatttttagtagagatcgggttttcaccatgttggccaggctggtcttgaactcctgacctcaagtgatcctcccgcctctgcctcccaaagtgctgggattacaggcgtgagccaccctgcctggccgaggttggcaattctgacgaaacaatcataacattttggaactgaaaactgtcttagagacctaaccaatattttaagaagaggaaatggaggatgagtgaaaaagcgatgtgtctatatgtgttaattaaagactaaagatctggaggaggctatgcactgcagacactattaacagaatggagtccatgtaaataaacaaaggggtgctcaaagttaaagggaaaggcaacagatttgtttggggaagagcaggagttcatggtggtcacagacataagaagaaatgtagtttttcacgggaatagtatcttttctccacggtgccatgatgcttttattattttgggtgtaatttctcataactggaaagcatttcagccccttcccagtcctcagaggttgaccatttttttctctcggattcagccacaaaggcagctctaccactcaccatgtgtctgtctttgactttgtcatgttgggaagactcaggaccccacctatttttacccacagggccctctgtgcctatgaaactgaggtcccagcagtccttgtggacatatcacaatctaaaattcagggataagaaaatctacataggaatctctgcttcactcacctgtgagactcttccaggctaattttctttgggtcatgtggtaatgcaagagaaagttgattctatagcaacttctgagcacagacttggctgcaatatgtttcccctttacacagtcatattttccaggatttaatgggatgtctcttgggaggcaagaaagagaatatgccagtgtggaaaaccttaactcctgcacgttgaaaatttcaagttctgctcttttggatatttaaataaggacctgggtggtgatttgctcacccagagattttctctgtcaatctctgtctctctctctcaacttcaaataataaaaaacgcataaattaaaaagtgaaaaatatccaaacaatccttccttctgttgattttcattaggcacatttcaaagggttactgatcattcattatgaactacagacttcagatctgtatccatcctttggagatagaagataagtagcaatgttattgggtttctgattgtgtttgtagtgcatcaggtacaaattattaaatatttcctgccaattctggaaacaataaaatagaacaatctatctttgttcttttactgtaaagccctgaaattaaagtagtgcgactttgtgatgtcgttaagtgctgaggatagcagttcattaatatgactatgtgaattacacctgagggcgggagggggcgctgtttcagaatccagcctctttagagagcaaaacaataggacaccaggacggcaagccaaacccagggctcttcagtgaagaccacgatacaaggctttctacgttatctgacaatgagatagctttgctttctgcttgttcttgtctctctggccactacggcgggtggcgttgattaaagtctgtagaagtcccttgctttgctctatatttacattgggaggtacaagatggcctccttggcaaggcatcaaattacattttaaaaggagacaaaaaataattgtagcacagggtcagcagttggatctctgtttgtaagtgttgttgggcagaatggccatacggcaggaggggaaatcaaggtacaagtcaaataagtcaccttcccaaggtcccctgctaagcagtagagctgggattccaggctttgcgtatttgtacatgccatgctgtgctgcctctgaactgcacttgagatgtggggtctaggcctggtcttgcctaatatcgtggccagtgttaggaaaaccactaatccgtctgaaccttagtaacagtgcctaaaaggtgaggatgttgacacttaccatgcctaattcaagagtttatggtgaggatcaaaggagattatgtattaaaagtattttataaaatacaaaatatgagaataatgaaaagagtctaaaaaaatgtaagactaaaataaatgtcacattgtcttatagcgtgttctgtatgttgcatttggagtgtggcatccttgggggtggttcagtagtttcttcttttcctgtaattgcagtgttgagacctaggggcttgcccagatatgcactcaattttcagcacaatattttatagatggaatagaagtacacatcaccatctgtgcaagaggccttggaggtaaacaacctgaggcagtatgtggaccttccaggatccagattctaataaatcaactcttaaaaaggcacttatgaaatgctcagggtcatttgaatacagattggctgttaaattgtatttaggaatgaatgctgattttttccaggggtgataatagtattggggttctattttacaaaacgagttctttccccctgagttacaccttctagagtattttcaaatgggcacctttgaaataatttatttttatttgagataatctaggagagagttatcaagggatgaaacaagactaaccacatattgaggctgggcgatgcctacgcgaagggccattacactgttttggtagaaagggcacaatgcagcctcagtttccaccctgacaaggtgaggatgatgctgcttaccatgactagaagctcgtacgtggcattatgtccttctattaggaagcacagggtagcaggttgtctttctggcttattttaatcgctgttgacattccttggctagatccctgtttccctatgtgtttgcaaaatggcgacactcctcatttattagctggactgctttcgaagagagaagcttttgactaccttaaaatttggtttggacaggaaaggcaggcaggtcaaatgtttcatcactcacctttctttacaggttttcaggatcaagaatccacagctcagcgcagggctgctctctgctgccctctgctggatgggaccctccacagacgcccacttgatcaaccccttaagctccaatgggttcccaagcttgtcatcacacatcacctcttttgtttttctcctcagaggtctatgttttgaaatatagtgtattctaaacaaggcacacttaacattgatttactttacattttaattaacacacgatatatataactcctgagcaaaactttcgatcggaaaagaaaaccaatattatcaggataaaaatgatgtttttcttaggtttatagctgattaggtagacatattttttgttcaacttataaagtgttgaaactcatgcttaactcccattgttattctccattatcacaaccagaggcggctttccagcctgtattcttcttcaatctcctatattggctttgcattgagtggaagctcagcaaaccttctttgataactgaacccgtggttgcaatggggatgcccttgctgctaggccgcaggaaggaaagctactgaggtcctacttccagcgactctagggaccagcactactgcgtttcagggttttgtacgattcagtaagctctcatcccattttctcaaacagcatgcataggtgttgggacatcttccaattctgtattcttggctgcgacatttcttccggcaacgggcagtcccataaccacatattctgtccaattcaaattcgcttctcactagataacaggatatggcactgtcattaattgcttactggcaccaaaaggcaaggctttggtagaaggtgttttcggaggggggtagagaatgctagtgcatggtggtagaggttttcctggacccccatcctcctccactttcctagatgattgacttgaccttctgattcccaaccagcatggattttatttgaaaatgtacatcattccatgtcacacttattttcaaaatccctacaagtttactattgttttctttattaaatctctccaagccccttacttggtctccaaagcaatcgtgatctgatcttgggccactttttcagactcatgcttttccactgtggccctcactctgtccatgaaactctcgccggcttcccttctgttccgtgtgagcttactctttgctatcctggtaccttcacgtgcactgtcccctctgcctggaaggtttttcttccttcccataagtgaattctttgaacttttatgtctcaaccttaagttcccaatattgggcaaatctttctctgtcctcttcgtgtattcaaatgccccaaaagtatttttctccctatgcatttgttattcttttatatcacctatcgcaagttgtagttatatatctatgtatctatataggtatatatatatacacatatatagagagagatacatacaaacatagacatagatatagatatgtatatatgtatgtatattttgttatttgctattctcattcgaactatgagctccctgacaatgaggcccatgtttatgttgcttaccattgtgtaactgctaccaggaacatagcctgttctcaataaggacgtggtgagtaaatgattggatagactagaccagaataaactagagtggttgcaagtagagaggaggaaactagaaaggagcagaatcctgattgttcggccgttggcccagagcagttttcaggagacatggacttagcttctcagtctcagggtgcgctctctgaggctgaaagcagctttgtaaaactcattatctcacatgccacactgataggatcttacagagatatcaggaaaacccagaagcaaggctgatggtagggaggacagcgtaaggtggaccgagagagtctcgctggagagagctttgctagaggttctctagcaaactcagcaggagccaggcttgggagagggtgtcagaagaaccctggggagaggagagtcagggctgcaaatggacctctttgcagaggtcggggcccaagagtcctaatttcatcttagccttaagtccttctcccctgttgcatctgttccttttctacaaagcagaaacgggctgctaatcctcgcaccagggttttatgtctttcatttgttctggtaaagagaagcctcctgtttctgatgcttaggtatcaaggttctttgtccaggatgtaggtgaggactaaaaggcagtttgaccaattcatgtgctggataggatattgaaggggttaatatttggaatggccccacagcgggtgatgaggaaagactgttttgctgtaggcttcattcaaaagcaagcccctgtggtcacagtacaaggcaatgaagaaaggagtgaggtgggctgcagtgtgtatcatgctgagggagtaggtggaggttgagtagcagatatgtgccttctgacatatctgtggcaggtcgctttacaacctggagttagaggaggaaaaagaggacagcatgcttgctcagggaaaacgaagcttagcgttaggggagaaggagaatagactaggaagagaacccaacctttaaaatgttagactgtcagtttcaaacaagccctcacaggccatctatttagagatgggaatgaaggctcagagaaggaaagtgactaatctgacgtcacacagcaacttatgtgtcaaagctggaacagaaacctagttggtatgtcttacagtctcagtaaacagaatgcaaaagggagaatgcagtccatacactaaggctgagtaataaacatttcctaagcaataaatacattccagggtagactacactacactagtttctttcttgcataagcaattttcctcctctgctctacagacccagaaaatcttaggcaggtctcaggtcttagttaatgtagaaagtttattttgtcaaggttgaggacacacctgtgacacaacctcaggaggtcctgaggacatgtgcccaaggtggttgtgatacagcttgcttggttttatacattttagggagacataatacatcaatcaatacgtgtaagatttgctttgttttttttgtttgtttgtttgtttgtttggttttttttgagacacagtcttgctctgtcgcctagggtagagtgcaatggcacgatctcagctcactgcaacctccacctcttgggttcaagcgattctcctgcctccgcctcctgagcagctggaattacagacatgcaccaccacacccagctaatttttgtatttttagtagagacgaggtttcaccgtgttggccaggccagtctcgaactcctgacctcaagtgatctgcagacctcagcctcccaaaatgctgagattacaggtgtgagccactacacctggctgatttacattggtttggtccagaaaggtgggacaattcaaagtgggggtggcggggggcctgtgggggtgcagtgggagtgtgtggcaggtggccttccaggctataggtaaatttaaacattttctggttgacaattgattgagtttgtctaaagacctgggatcaatagacaggaatgtttgggttgcgacaagaggttgtattgtggaggccaaagttgtatcatgcagttgatgcttttagctagcaggcttcagagagaacaggctgtaaaatgtttcttatcacacttaaagtctgtgttgatgttcatgatggaaagtgtaatgaggcatgtccaacccccacttcctttcatggcctgaagcagtctttcagattaaattttaagagccctggctgaggagggagtccatttagatggttggggagggggcttagaattttatttttggttgacagcacccatccccagtccctgtgggtatctgaggggctgacagtgtgtgacagccaaacttacccaaagcaggggtggcaggagaagaggcaggcagcgcatgtcattcaccctcacccacttctgccacttccctccctaatcctcttcctgctaatggtctttctcagaattcaactgcagaggacagtctgacccagccctcagcagccaagtgtggataatggcagccagctctgcggtgcattcttcgggatctggagggatccctgacccaggctttccatcccaagttctttgtcttgggatcaaaggttgaagaaaacctgttctttgataaattgctatcatattttaacagacctggaacatgctcatagcagaatttcacagaagtgtctttgggaaatgacacgggaagaaagaaaaaggaagagttaacctaaacaggtaccctctgaaaaaaaatcattaacccatctgaatcacagtggaggcacagcctggaagggtaaaaagatgggtgctgggtgtctgtcaaagccccataaaattgactgagcagcttggaagagaagatccgatggcttctacgagtcaaaacaattggtttcgtcccagcactgctagacttgttaagcaactctaaaaatcttattttctctcactgtactatagagaatgctgctcagcttgtaaaagaagggaattagattaggtgctcactcatatccattgcaaatatattaagaaatacatgcttctggggacatagattaacgtaggagtcagaagattgctgacatctcagtctaaaatttcctgagcagagttcaaaggcacctgctatttgtgttgtcagtaaattacgttcttgcctactgaaatcactgcatcccctttaatcctaatcatctgacttgatatgaaaagttgcaaaatttaggaggatgagtaggcgccctttctgtgcagagtaaagctgttcagaaggaggaggatgggagaaggcatcttattctacaaaatcaacaatgaataattgctgctgccctgcaatggaacaagcatggctagtgagtcctcactgctgaggattccatgaggaattgttaccgtgtgtggccagggtgccaaggacatctaggactcctgatccctacgtttcttttttcctccttgagctagtaagcctcatggctgtaaggtgcatacaaggattgccacatactgcattttactaatggacccaatgaaagcaaagagaaaaaaggctgagattgaagaaggttactccatccttcaggatttattttctaaatcaaatgtttttcttctccccctgtcatccccagcaactgtgtatatttccagctgagagtccctttttacctggaagatcttgatagagtagaagagaaatggctaatagcagcacaagtctctgcataatgctggggctgctggcgagaagcagacgcaagtcggagggaatcaccccaggcaggagcagggcaggtgtatttatgggcagaggctgctcttgattactgaggcttatcaaaatgcagcgttccttggtgaagactcaccaaggcacagtgtgggggaggtgttggggctacagaaatgccagctgggcagtgttgagggtggggagacagtattaccataggtaaagtccaagtcacttcacttgcttccccgaatcgtttctgaagcaagaactggattagatgatctctaagataccttccagccttgacattcctcaattctggtgagaggactttctcttccatttcagtacatttcagtcaggagattcttgttgaaaactgtgatgtggctaatggaattgaagtccatagcccccaagacctctctgaagtaaacattgaaacaaacatacaacgtcaaggagaagaatggcatggagcgtggggaggtcataaatgcgtgaaaagtcccagcacatttctgtgatagaaaaagtataggatgaggatgacaagtgacaacaaggaatacttgatggcgggcattgtccaagggtgggattgtaaccacagagcatcaggctcacttagggcttaggtgaaaaggaggacaagaatgagaagagaggttaaaaggagacaattcatgggaatgctgtatttctaacaatggcttcaaataaaacataaccttccagagagcatacgcctggccctcaaccaggggtatatgctccctggatttaaccccaaccccacccgaggcaaaacatatagagcatatgctcctggcatttgcccttagggaaaacaccagataattttattttaagaaaaaaaaaaatacttcatttctctaaaatgaaatattttagagaaagtaaaaacgtccaatcttggaagttgacattctcgaataagctccccttattctagaacacagattagacaaagcctgacagacatacgttgcttgcacatcctaagcaaaatctagcagtcagtgtgtcttccccagagttctcacttaggggagaatgtgatggaaaaccaggtctcctttcacagtaacggaatagaatagaacatcagaaatcataaactatgccagtttgggtgctccatgaagcatttatcaacaggaattagaaaggaaataaatttattgggaaatgcctgtgaaagataaaggggggccaggcgcagtggctcacacctgtaaatctcagcacttggggaggctgagcgagggaggaggatcatgtgagctcaggggtttgagtccatcatggacggcatagagagaccccgactctacacaaaaagaaaattagccagggatggtggtgtgtccctgtagtcccagctacttgggaggctgaggcaggggggtctcttgagcccggaagttcgaggttgcagtaagctatgatggcactactgcactccagtgtagtaggcaatacagcaaaaccttgtctctgaaaaaaataaaataaaataaaaattcaaaacaaaaagatgatggggagagggagcaagattgagtagggaaagtcttcagaacatgacgtcaattaacacctgtgaaaaggtttggagtcgggggagcctcagactacagtgcagaaaatttcagcattgccagtggggaaccccagggcaaagactgtcctacaccagcagacatggcccagctctagtccacattgtgctcattcactgcctggaagcagccagggcaagagtggtagccatgggaatcctgccgcaggttacaaacgtgcagcacgtagaggccgtcggatactctcctcacagcagacacacagcaagcacaaatgtgcaggatccatgggaccctcctagcctgccacatgtcaggctttagtaatttttgatgatgagcttcaagggaaaaacatcagccaatattcaaggtcatctatgtgaccaggattctgaagaaaactgaaaaattctgatgataataaatattcagcaattcttcaaaaaaaaaaggtaattcatatacagggactgaataaccaaacttcaaaagaaatcctatatcttcttaggagaaaaaaataataaaagctttatttgctgagtccttatgaagtatttcagagttctggtttcggtcgctacaagtaaaaagactgaaagtaactactttactccttaaagaaagaaaaaaaaagccaaataaatggaaaaatcaatgacttttcttggacccattagggaactgagggctccgggcaaacccattgcgtggaaatctggagtcacagctgagatgagctaacctggaatggaagctctgaaaccataaactagcaggaacacttacggtgacttcgacaacttgctggaggctgaacgtggacatttaggagagtgaaaaactgctagagaccatggtcaaaggctctcccttctcaacccctgctttcctgggttttaaatccaggaagcccccaaggttatcatggtgaagagccagaatggaagccctcattgccctgaaaggagaagggaagagtgatattgtgaaacatgtccagaggattccccataaccaaagcctcctcctctgcaggaaaaacaattttactcgagccatatcccacctggaggggaagacgtttccctattccagccccatctgaccttcctgtctcacttgagggatgggggtagctaagaatttcttgagagccgggcacggtggctcatgcttgtaaccccagcactctgggaggccaaggtgggcagatcaccaggtcagaagttcaagaccagcctgcccaatatggtgaaaccacatctccacttaaaaagtacaaaaattagccaggtgtggtggtacacacctgtagtcccagctacttgggacgctgaggcagaagagtcactgaacctgggaggaggaggttgaagtgagccaagatcatgccactgaactccagcctggtgacagagatttaaaaaaaaaaaagttcttgtgacagtcacagtgcagggacacacaggctcaggtaaagatgagatttacttataagattatagaatgcttccttttcccctgcctcttttttgttcatcccttgcagctgtctgagacataagatccttaatatcatcctcaggttagtcccattcaaccatcgcctccatttgcaggcttgaccaggtcccagtatcatgtggataaattgacaaagatcaggaagtcatggattgtatgtttaaatgaggattctaaattcctcagcaaattcctgggggttttcctttgggttagggaagtctttcactatttctgtcagttcggattttgaccaagacataaaggtaattaaagaaggcagacacagttgatctgaggaactaactttagaaggcattttcctaacttgcttctcatcttcatagtagaaaggcagctgagtgaagagggtagtggaatcagagtaattaggcagaggaagaagagagacaggaggaaaagaaggagcattgagagttgagtgagtcaatgtgcaattttttatcatcactgattaagtgcttaagcttttaatttgccttttgtaaagagtctttaagaaaggcaagttctgatttgcttagtcttttagaagcttctgcatgccaattaaaaacatatctcatttttttgaggcatttaagatcacttctctttcaatgtagcttatagatgaataactgtttaggttaaaatttcttcactgtgaccagtgtaattctaagttgtctttagtaaagtttacacatttatttagaaaaacacaggttctgggtccataatttttatacatgaacgtagctagagtcccagatggagaggttccagactacctggatacagatgaactcatgattctttgtcttccctaaaccctgccttcttaagaccttctgttggacccagtccagtttctgctggatccagacacagagagaaagcggtgagtaaaaccggctcagctggtaactacatctggctactcattgtcccaggaaccattatcagggcttctttgggtccctcttctgacaacagaagtattaaaaaataaacttaggcacataaaaatcttagagttttcttttgagcagatatcaatttaagaatcgggcaggctccaaaacacaagtcttttggggctcacgcaaagaggcacgaggaaaaggcttttatagggtgaaaatggaagaaaggcaaattaaacatctaattggttaaggtggagtataagccttattcgaatcattccattcccttgttagaggttagttggtggtttctgattggttaaagttttcttttaccattcaaaccgagttgggttttagtttgcttatgtagaaaccgagtgcactgaagctcccgcagtctaatggcctctcatttaattattttaacaagagaaatattctgtgttcatataatagagaatttaacgttaagatgtcaatatttacaacttgacctatagattaaatataatcccagtcaaacttttagcaaaatatgttgttgacatttccatactgattcaaaagacctaggatcgtcaatacaataccggaaagaacaaggttggtggatgatagggtttctgtccccatctaaatctcatcttgggttcttgctcccataatccccatgagtcatgggagggacatggtgagaagtaaatgaatcatgaggtgtttcttttctgtgcttttctcatgaaaatgagtaagtctcacaagatctgatggttttataaaggtcagttcccctgcacacgctgtctttcctgtcaccatgtaagacataccttgctcctcctttgccttgagtcatgatggtgagacctccccaactgtgtggaactgtaagtccattaaacctctttttcttcataaattaccccatctcggatatttatttataacaatgtgaaaatgggttaatacagtgaacttacactaccttatatcaagactcactaaaaaactgcaatgatgaaggcagtgtgggagtggtgaagcaataaataaatagatcaaacagagaaacagaacagaatggatagctcagaaaagatcaaagcaactcctctctatcaaagaagcaaaggtaatataatggaggaagaatagtcttctcaacaaatggtgcttgaacaattgatatccctatgcaaaagagaaagagaaggagaggtagagaggagaagaggaggcaatgaagtgggggaaaagagggagggagggagagagagagagagagagagagagagagagatggcctacgatgagggagtgattaaacaaactgtggttcatccgtatcctggaatactgcccaacaataagaaggaaagagctattgataaatgcaacaacctggatgaatccccagaaagttatgctgactgaaaaaagccagtctaataaggatatatacattctatttatatggcattcctaaaaggacaaaattgtagaaatggagaataaatcacttatacaggggttaagacggaggtggaggtgtgagggaagagagagtggctctgaaagggtaacatgagaagtcctcctgataatggaaatgttatgcatcagtgtcaataacctggttgtgatattgcactatggttttacaaagatgttactattgaggaaaatagagtaaaagatctgggtatctctctgcattattattattatttttggaactgtagaggaatctacaattacctcaaactagaaagtgtaactaaaacatccttttcatgaaagggttattgattctaatagaattaaatctatcgactttgaaaaattaaaggggaggtaaggcaagatttctgagccagcaggaaaccaaaactaactcttgagcactggaaacatgataggaaattcttacttaaactaagtaattgtctcagtccattcatgctgctataataaaataccttatgctgggtgatttataaacaatagaaatttattacttacagttttaggggctggaagacctcaaaagatttactatatcctgaggacccagtttgtgctttcaagatagcaccttgttgctcagccttcacatggcagaagagacaaacgctgtgtcctcccatggtggaaggagcaaggcagtttctttcaacctcttttataagggtgctaattccattcatgagggcagggcccttgaggcttaatcacctcctcaaaggcctcatctgttaatcaccagagtggggattaggcttcagcattaattttggaagaacacattcccaccataacagtaattttgaggcttagaatcagaaggtaaactgtcagccagttcctaggaaaatcgtaggcagtgatttggggaagagggtctaaatcactagagttactgagactcatagaggtaattatgactcccttgcctgtcagcaaattttatctcagacttacgtgtagagaacaagtctatagaaaatatttaactagccccaattaaagacatggggtcatgatgactaatttagacaggtgtgtgtgtgacacataaaagtctttgataaatggaccgcctatccatcaatttgtcgttcatgtagctattcatgtaaatgtatgctcatttatgtgggcatatggcatgatggtaaaaatttttaaaaagtgtgctcttgcgatagtttgatgagaatgatggtttccagtttcaaggacaaaaaaccaaacaccacatgttctcactcataggtgggaattgaacaatgagaacacttggacacaggaaggggaacatcacacaccggggcctgttgtggggtggggggagggggaaggggggaggggggagggatagcattaggagatatacctaatgtaaatgatgagttaatgggtgcagcacaccaacatggcacatgtgtacatatgtaacaaacctgcacattgtgcacatgtaccctagaacttaaagtataataaaaagaaaaagaaaaaaaagaataaaattttgttttgtattaaaaaaaagtgtgctcatttctctacctattcatcttctttccacctccctctctcttttctttattttcttttgtttacttctttcatgtcaataggttagtaagcgccaacttactagactgagcacaagctagagatttgttgatttctagtctcttctagtcctcttttaagaaaaatttcagatggctttgggacgatttgtctactccagaatgatagaaaaataaaccgggatggagggagcatcaaggtcaggcagtgttgttctcctttctaaatgaaacacttgacaaactgagcaaagacagtcatttatttttattaaagtgtctgcctacagcagaggcaagagtaaaaagaagctaggttatgtatgcttctctggaaacctaaatcttctgcattaatctataatgctcccacatggctggatggtccgacagcatttcagagacttctggcagagagcaataagttcttcatttttcccgcaattgttcttgcatgtccctttaagtttgttgcatttctcatcaaaaaatgcattcttggctacacgagggaaggagccatttggattaattcccttttcagacatgtatgtttaccagatacggttgtatgactacttggtgaagattttttcacaagctgtcatagtgccatatcctaccggtagatgagatggtaggggacctgatttttatctgatatttcagtctcatagtcacacagggtgaaataccggaaagaatacatttgtcttccagcatttgagaccaagctgtgtaggagctttgggaaacgtccctaagctatggttctttaatcgaaatctgttggggataattatcaacttgttcccataaacactcccagaggctgctaattttcctagtgcactctcagaggctgctacttggtgagagtagagcaagagctgagactgaggagatagctccagaccagagcaaaggaagggataaagatataaaaagagaatgagtttactgtggtagatagaaacttgcttggaaggctcagcctgatttctcctccatattcaccaaagcaacgactgcggaaaacttgtgctttagagaaggagggtgcagcatgttgggaatgtttttctaagattttctcagttcattttgtggagaattccagttcccaccttagggctttatcagtagcagtcccaagagcagcctgcttcaagttaaggacagacagcacgtcttatcaggatcaacattttagagctgcccaatttgtgtatatataatgaaggcatcagatgtacagagattgcatttaatgtctatactataatgtatatacatttaatgtcaacatataaaggtgcctaattcaaatctacataaaacttacagccaggtggattagtgccagcatatgcactaatgattatccaggatcagcacatcagttcataagtgaaaatactccactatttcaaagctcgatgaactctggctctcactggcaggggtctatgttctctctgccctactgtaaggcagatactaatataatactataccatagactatagtgtggtattcagataaaatctttttggtttagtatagtatcatagtatagattagtatatactataaaaatactagtattatagtatatactggtataatagtgtatactatagtattatactagtatatatactatactatatactagtgtgttatagtagtatatatactatataccagtgtattatactagtatactatactatatactagtgtattatactagtatgtacactatactatgtactagtatataatactactagtaataatatagtatatatactatattatcataccagtatatatactatactatatactagagtattatactagtatatatactatatactagagtattataatagtatatatactatactatatattagtgtattatactagtatatacactatactatatactagtgtattatactagtatatacactatactatatactagtgtattatactagtataatacactatactatatgctagagtattatactagtatatacactatactgtatactagtgtatgtactagtatatacactatactatatactagtgtattatactagtatatacactatactatatacttgtgtattatactagtatatacactatactatatactagagtattatactagtatgtatactatgctatatactagagtattatactagtatgtatactatgctatatactagagtattatactagtatatatactatattacatactagtatataatactactagtaataatatactagtataatatagtatctggccaggtgcagtgtctcacacctataatcccagcactttgggaggctgaggagggtggatcacgaggtcaggagttcgagaccaggctgaccaacacggtgaaaccccgtctctactaaaaatacaaaaaattagccaggcaaggtggcacatgcctgtaatcccagctactcaggaggctgaggcaggagaatcgcatgaaccccggtggcagaggttgcagtgagctgagattgtgaaactgcactccagcccggggaacagagtgagactctatctcaaaaaaaaaaaaaaatatgtatatatatatatataaaatatatactagtacaatactatatagtatataatactagtacaataccatactgtaacatcagtaaataattatagtatatactatgctatactataatactaaactaaaccaaaaagattttctctaatactattgtattatagtattatactctagtatatctaataggtaattattagattatctaataattatataacaagcattatgtaattatagataagtatctgtaattacataataattatagtaactaattatacttttataattatagtattatctaacagataattttatagaatataacatcttttttttgacttattatataataagtatgagtgatctgaaaaagatacctctggccagtttcgaacgtgcatatcaaaaccagtggcctgaatacggcataggtcactgtgggtcctagatcctcatgttttgacacagaatctactctcacaggcttgtcacaaaacagaccagagctatgagcagctgatgtgaaaagttgagcatcatacctgggatcgtatatcactggtatctggcacaaattgggagttactgtgggctctgagaatccctttcttcagctctctggaggctcacatgagcctggtcttaagccttaattttgaagaggatacaattggagccactggagattcccaggagcaggagaaaatgaagagagttttgatatgggaagggtgtctttaatgcctcttactgtggcaagacagttgggctcctaccctggctttgttttggttatctataagactctgagaagcactgagcccatctgaggcacaatttctgcatctgtaataaaatttgtaaaatggaccttcaaacccaaaaagattttctctaacttccattaaattaggggtaagacagagttttccgtaaaggcgctggcactggaagactagatgcattttatgtgaagctctcatcacagtacttggcttgatgatatgtgatcaagaaatggcagtccaagttacgctgctttacctgttgccatgactggcatgagtgcataggtgtctctaagctcagatccttacctgtcccttctccttacctgtctcaatctctaccataactacattttaaaaggttcatagactgctatccttgtttttaattttttctcaatttttgtttttgttagtgagcatgagatgggatgccaaaaggcatctttcctggccttcttttattctttcaaacctgtgacagcccctcctagataacaatgtaaaatgcaaaggaattacagaagaggcgttgggggatatcacctcttgtagtagatgggttgatcacgcccaggcattcactgaaggggaccctgtctgtgggacaccacctccgatcaccttccctgtaaagatgcccattttacctggggtcagaaagaagagcacggcaaagagaaagaggaaagtcctcatgactgggtgggtcttgagagatcagcaccgtgtccatgaggaaagagccgcaaacacccacatttatacatttctccagaccaagtaacatcttgatcagtgaggcttagcagaaacgagaggatttccatgctctgctgcacagagcccacccaacctcagtgggtgtcactcagtctacagctcatcatatttctgattctggaaagttttgaagaaggaaagtggggatgaagggaggacagagtagggcagacacagaaaaaataaaaaaatctggagtccagtagtttcgtttctaatcctggctgtgttcctgaacagctttggtttactcatatgtaaaatgggagtaattatacaatatctcaatgcttcagttaagagctgaggaaccgtagtgaggtggaatctgaattccagattcagtctttttgagctttgtaaacttggcaaagggcttgacctaagcatatatttgttaaaaaatgtgaatcttgctgtatgctgcacgcttttcgtgcttggtcctgccatgctgctcacctgtaccatggcactgttggcgcagcaaggggctggtaaccatcatgccttgccctagacacctgggctcaagcaatctacctgccttaggctcccaaaagctacgataatagacataagccacccatctgggccaatattcatgtccttaatgaatttaaaatatgcagtaattatggctttggtgcgtgaggtgatatcttacaggaaaggggactcagagctaacttgacaaaatgattgctacccctccttttctccctgtgatacttgtagagaataaaaatgaaagctagaaaagtgagagtccacatttattgagttcttacatggtaccaggcctccttccaagcattccacatattcaaaacacttttgcattataatcatactagattcttacaacacctttagaggcaggcagaatttgcaagtgggttcttattttctcccagaaaacagaagctggaagagatgaaaggggtcactatcttctggcccctgcattagtatggtggaaactcacatggcccctgctctttcaacctctagcctggtgttctttccactacaccagttagactccccaaaataaaaggctttctggatgccaagggttattatccatgatatcatccctttatcctgggaaatggagcatataattgtgttttattgattcacttcacggatcaagagcatctccccattacttttaaataaaaatgagcctctcatttgggtcttctcaaggaaatcccaatctctattccgaagagtcttccctaaaagatggccctgatcaggaagacattttattttctatttgctatgttcttcattttggttcaactgccatcaggtaagtaaaaatggatgggattttgattgggcagattataaagcctgttgattcttccatgtttgaccttaatggtcaagctctcatggcacctgtcatgggaatttcttagacctacagtgacatttactaagagcaaacagcatatagtgtatttttttttttttgtaatttgtttttgctggttacctggaatgctggccttgagaaacagaataaagattgcaactctgtgatctactgtctcctgttatgctatgtcacatgtgaagttgggagtgttttatacagtgttaattcctgtgttgattttaattttcaaaatgtattttgttttgaatttagggtgccaggcaggacttgatttttcccaaccatttccatcaggtaagttaaatctcttgtatataattattttttctcttaggagctctggcgctgttaggtctctctgatgtctggaggcaaagaggggacagagatagtggcagaaatagaattgtctgaaaaatcagttcactaacttatctccttctctttctcttgttccaagtataatatttggatatttttgatttcacagaaaaatatctttgtgactggactgtaatttggccatagagatttggactcagtggcttttcccattagctgttggtgctcactaaaccaagttcttagatttattcttgtaccagccaattagcactgctctgtgaacacgcctgcccatctcttgcaagctctgctgctaagtctggtaataatatatgtcacaaatgcatgaggttagttgaaggaagctcaaattaaagagtgaggttgcctcagtgaaaactcagcaccattgcagaaaagctattcataacgaatagcccccagatcttttctttttctttgaagtcatcttatacagaaagaaaggacattgtaaacaaaactaaaagaaatattgtagacaaagttgaaatggttttagacagaatttcaaagtgagaaatatgaaggttgctactagtccttgagtgtttgctctgtaccaggcatcctgctaaaaactttacatggactttgtcatgtaatcctcaaaacagtcctatgtggtaggtattattataatgaaaatatttacatataatattccatttgatccctaaactgatttaaaaaatgtagtcaggtgcttctagaatggccactggacaaatgagaatatggaccttaacctgccggctactaggcccaaactagagttgatcttcaaggatctttaaaaaaccacaatatacccctcccattttttgtctagtaaacttcacagtcatatcaggtatgtatttttatagttctgtaatatgtatgtctctttgtctgtctgtggtttacttttgatccctgccagattataaacacttggagagtaggaattgcgatgatctgttgcataaaaattaactctccccaactccctactgcaaaaagcagaaactatttttgaaaaatctgggctgattcttgaaaatattctttgtaatcatacgtacgaactgtccctttttttttggtggtctttgacatgttccccatttctagacatttcctggaaagctccctcagcagctctttcttggcacaggtgagtttgctgtctgtgagtcgtgcaagcttggtcggggaaaatgcaggaaggagtgcttggagaatgagaagcccgatggaaattgcaggctgaactttctctgctgcagacagaggatctgacaaaccagaccagcacacttctggccttagaagcagacctggatattcaaagaagttcaagagaagttatgtggcttatccaaatcacacagtgagtgagtctcagaatcattctcatttctttctccctttgttacgttttattgcttattttttaaagatgactttttttcttttttttttttttgagaaggagtctcactctgtcgcccaggctggagtgcagtggctcgatcttggctcactgcaacctccacctcccgggttcaagcaattctcctgcttcagcctcccaagtagctgggactacaggcgcataccgccatgcctggctaatttttgtatttttactagagatgaggtttcaccatgttggcaaggctggtctcgatctcctgacctcaggtgatctgctcgccttggcctccaaaagtgctgggattataggcatgagccaccatgctgggcgagatgacctttaaaaaacatcaagacatgagtgtgtacctagtatctgctcaatcagataccactactatgtatatgtagagtaccttacaatttatgaagtattttccatacttctctcatatgactcatgattaccttatgaggtaggttttattactgccatttatatttgaaaatattgaggctcaagaggctgttaattcttcagagccatagctaggatccagtaactgctgtgcacattgctgtcatgttttatgtatccatctatatgtactaactatgttaatggaataataattctatcaaatataatacattatttttatattcacattatttcttggtttgtctaaatattgtcattcattgattctagtacttatggtgtatttacctgtgaaagaaaatgattagagattaacttaaaatgttcaacacagaatatgcataaatggttgactgtctaattttgccttgtgaaataaaatccagcttcacaaaataaaggccaaaattaccagccctatgaccagtgacttgaacttggttacttagttttaacgtatgagattaaacaatgttttgtttaacatttgggcctattatttgtctctttgtgctcaaatctgttccttgtttttttctgctttgctgagtaaaatgggaactattagttgcaaactacattttccaggcttcctgacttctggctagttttggtcaatgtgtctcctaggagaatgggagattgaagaaggaaggacaatgtgaatttctccccgactccctctcttttccagcagtggcttttcatgctcagcaaggccgctgcttttctgtcttctgcactcacctggcagtcccaccgcaagtttagcttctgccagccagtgctgctcccaggctcacacaaatccttccatttttcctcaaaccttagggcagtgggagatttctgctgtgactatcagtagggttgcctcattgctcccgctttgcattgtcatcttttccaacactttatctgtacatattaaattctttctatagaactatccattgggggaacccttttaatgcttgattggttcaatttttagattcactctatttacatatgatccactgttttccaaaagagatttgaaacacagccctcaagaagcctagagtgtttccttcatttacacaggaattaccccagggaagtgggaagtggggtatttggtcttaagagtccagttcacagtaattttctgctggcagatggtcttcctccccaggtctccacagtgcaaatgcagctgctagcttacagaacaccatgaaactggaatactacttactcattccaaatactgcattgctttatcttaaaaaaatgctctggaacctagttgaagtttcttttaatgaaagattcatgtgagtgtctcagagtcatacaaagtggtagaccagtagctgtgccctgatattacctcactaatgacctcatgtagcatccagatggcagctgcagaggacacctcccacaggtgctcacctagtcacaaattgttccctttcatggcaggccaagtctcactaacgcaagactccataacaactgctttagtacccactgaggggttaagttaaatattaaaagcttaaaaagccagtgccctgatataaaggcttgaatgtaacaaaagcccactaagagttttgcttaggcctttcctgggccttaaagcatgacaaactaatgaaggagttcttaacaggacccgtttaggattaaacaagtttataggaggtctgaagaaactccccaaatatcagtgatttagcaggagacaaggtgagggtaataaccccagcacctggacccatttagattaagtacatttactgaggctccagaggaaggtcttcgggactcagaccttagttatagattaaaagaagttaataacttatgtctttagatgaatgcacacttacacataaacatatagcttggaaggtatataagctctggaaaactttgtaattttaagttggtctggcgataatttccaggacttctccctataactggttgcagaaataaaaactctcttcctcccgagtttatttgcatcttgttattgggctgtgagaaatagcagcccaactctccgtttggtccaggaacactttctttacactttagattcatggaaacaaagagactgaaagtaaaaggatggaaagagatttgccatacaaacaataaccaaaagagagctgtagtggctataccaatagtgtacaaaacaaactttaagacaaaattggtactaaagatgaagaagggcattttgtaatgttagcaagttaatctatcacgataatataacaagtataaaaacatgcacctaacaacagagtgccaaaatacatgaagagaaaattgacagaattgaagggagaaatagagaagtcaacagtaatagcaggagactttaatataccacttttaataatagacaaaacaactagaaaaaagattagcaaggaaatacaagatttgaatagcactgtaacacaatgacctcaaagcgtggaacactgcaccaattacagcaaaatacacattcttcttctgttcacatgaaatattctttagaatagactgtatgttagatttaaatacaagctcctcaatacatttaaaaggataggaatcatacaaagtatgttctctgaacaaaatgggataatagaaagaaatttgggaaagtcacaactatgtggaaattaaacagcataaatgtgaataaatgatgggtcaaagcagaaaacataagggaatgtagaaaatattttaaagggagcccccaaacactttaaaatatacaacacaacagcaacttacaaaaactgtgagatgcagctaaaacaatgcttacaggaaaatgtatggttgtaaatgcctgtatttataaagaagatagatttaaaatcagtaaattatcttccatctcaagaaaattaaggaagagccaactaaacccaaagcaagcacaaggaagaaaataataaatattagcacggaaataaatgaaatagagactaagaaaacaatagaataaatcaacacaacaaaaatttattttttgaaatgatcaacaaaattggcaagcctctaactagactgactaagaaaaaaagagaatactcatattactaaaatcatgagtgaaagagaagttttacaaaagatcttacaaaagtattttttaatattattaaggaatactataaacaattttatggcaacaattttgataatctagatgaataaatgcctagaaatgcatacatatcaaacctaattcaagaagaaatagaaagtctaaaatggacctataacaaataaagtgcatgaattgacagtaataacactaacaaaaatcccacatagtaaaacccagggccaaatggctccactggaacattgtaaagatgttactctattttattttgcctcgatttttttttcagacagggtctcactctgaagctcaggctgcagtgcagtggtatgatctcggctcaccccatcctctgcctccggggctcaagtgatcctcccacctcagcctcctgagtggctgggaccacaggtgcctgccaccatgtccagttaattttcgtatgttttgtagagataggggtctcattatgttgcccaggctagtttcgaactaaactcctggctcaagtgatctgcccaccttggcctcccaaagtgctgggattacaggcgtgaaccaccacacctgtcctggcttgcatattttttgatgagaagtttgctgcagttattctgtcatctttctacaggcaggaggcatgtatgccttctctgttgacaaaggtagaggatgttctttatttttcttttttaatgtgctcccttctcctcgttctcctagctttaatattttgttttgcatttttttagattgttcattcaccagtgccgtacaaacaactgttgttcttccctcagtttcttaattaagaaattaagactttcttttccataaaagagaaagattcttgcaagctttcgttctttctcacagtggctactgttcccctcagccgacttacatcatgaaatactctaatcttttttgtaagcacctgctgagtctatggagaagacattagaagttgctgtgaacttctcttttgtctgtgaccccagacatttatattgtttctctagtttatgcttgctcttagcaattctctacagactttacctgaaatcttttaaatcatattctgggggtaatctgcttcaggtaagcaagcactcatggtctttattttttggaggttcctgtcttttcttatatttctaggtaggtggctgatttgtgaccttagctttccaatgagttcaagaaactgaatatttgcagtctgccgtgtgttttgctgtgtacttgtttcatgtgggatgattttctttacgtatttctacatcttaagcagaagccattcttcatttaataacacacttactttctttaagacatacagaaatacttatattttctgctaattcttgtgccaattttggtaagttaaatttttgagagaattcttttattttatgtaagttgtgaaatgttttggcatatacctgttgacaacatttttatattagtttaatgtttcttggatctgtagtgataacttctttttcacttattctgcatacttgggcttacattgttcccttttctaaggttcttagagcataattttaagtcatagatttaaacatttcttcttttctacaataagtatttggatacaaatttctttcgaagtcattgttttgttgtgctccacaaaattcgatatacagaaatgctttccaattattctcattatttattctttgatacaaacacaatctagaatgatgttgctttatctccacatatttgaaaatatcctaaatagcttattttatagattgccaatttaatccccttgtggtgagaaatacactctgaagtatttaaatgtgcttaaacacatcaatatttgttttatggcctagcatatggttcatttttatgaatgtatcatatgtacttgaaaaaaatgtgtattttgcagttgtcttatgatgtgttctataaatatcaatgcagtcagtggaatggtggtattgttcagatcatgcatgactttgctaatttttccctgtgttctatcagttgctgagagagtggtgtaaaaattttctactatgaatatagaagtgtctatttctccctttaattaaatcaaataatataaaaacatgttaatggtttttatgtattttcaatggattaacccttttctccttaagcaacagcactccatgcaatacagcgagaccctgtcaaaaaaaaaaaaaaaaaaaaaaaacctgcacacgtactcctgaatttaaaattaaaggtttttgtgtgtttgttttaattattattttaagaataggttttatgtaaaatcatgtactaggaaaagcgtggtggctatatatcttatagacatggtaatacttgagataagacttgaaggaaaaatgagagaagtctaagcagagacacagaatagaatattccaggcagaaaggcagggttctctgcgtttgtctcccacaaatgtggtttagttaaaatctgatccatcagcccacacattagtcagtggagcatggaaaatagtatgttcccaatgaacattacaaaccgaggatgacttccagtcccttcagggcagtagaacatattttaatcaatgccccttgataaaagagcttgattccagctactgcacttccttcatcagctctccactgatgcctggagccatgaaaatatttgtctttattttggctgctctcattcttcttgctcaaattttccaaggtaagagggaaattcttctagaagtagagatgacagtctgctcaggatctgtcttttgagatgaaagctcaacttttacaaagttgaaggttccaaggcaaaccagtcactgaaaatcttttcctgagctccgacacaaaacaatgggaccacattgaccgggaccatctccatccataatagtttctagtcaacttccctaacagctctgccaaggaattcagacatctttgtacttttagatctctttcctcctttgtaatctgcaacgcaggttcagcatattctttttttttttttttttttttttttttgagacggagtctcgcgctgtcgcccaggctggagtgcagtggtgcgatcttggctcactgcaagctctgcctcccaggttcatgccattctcctgcctcagcctcccgagtagctgggactacacgcacccgccaccacgcctggctaatttttttgtatttttagtagagacggggtttcaccgtgttagccaggatggtcttgatgtcctgacttcgtgatccgccctcctcggcctcccagagccctgggattacaggcatgagccaccgcgcctggccagcatattctaaagtgatttctttaaaatgaaaaaaaaaaaaaaaaaagaaagaaaagattatccaaggaaatgccaaacatatttgttaagttagggaagtacagcctttgtagtctaaattaaactaaagttatgttactagattcttagacagctaattttttttcatgtctgagtcgtcggtccaaatctcttatccatacattattttagactttttggctttcacacactggttggaaattatgccattaaaaccactaaactaacatcttgcttactattctcttaagtctttgcgtctttgagattctctttgcttcatacaaccacgactctgttcctaagaaatgtttatgtccatacctcctcaactatccttcgttccttctgttgtgaagcttttcctattagaggttctccatgcatcatgaagccccctgtctgttccttcatggctcctgaatttctacattcctttattacacattctgtcctcagtagtcctagaaaaccaatagatattgaatgtgtgctaaccacttgtaagaaattgttctgtccactatgataaaggtaggtaaaacgaagaggtaaaaatataaagcatggacattgaccttaatttgcttgaagttattagtctattccttctatgttgttcgaaaataggttgcttgtagtggtaaataagctttcaatacatttaacatgtataagtaagtatatcaatgagacaggaaaattcacaaataactttaatatgaaacagttttcacaagtgccataaaagatgcaaattataaagagaagtcatagatgtggaaacttggttctaactaggaaatgcagaaaggcttcctgggaagtagtatttgttttgcacatttggaaataggcaagactagaactaaagaacagagccagggaacaatgtccccatgaaagtttcagtgactccatgaaagtctcagttgtaaaatcagttcccgattttctgccctcagcatctttttgcagatgtcagacaatgctccagaatagataaactcatttaaaattgtcttctccatccactttaatcagtactccaatttattcagatcagtctatagatgtggatgcctaatagctccctgtccacaaaactcatctcagatgtatttgaattacaataataagcatagtttgggcacaaattagaaccaccaccatcaccataatcacatagaatctcagagttagaagtgaatttaatgatcaatataaaaggtgtaggggtgggttgcccctacccacctgtgggtgtttctcgtaaggtgggacgagagatttggaaaagaaaaagacacagagacaaagtatagagaaagaaataaggggacccggggaaccagcattcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttggatatgcatacacataaacatctcagtgctttacaaagcagtattgctgcccgcaggtcccacctccagccctaaggcggtttttccctatctcagtagatggagcatacaatcaggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaaccctgagttgacacagcacacgtttcagagagcacggggttgggggtaaggtcatagattaacagaatctcaaggcagaagaatttttcttagcacataacaaaatggagtctcccatgtctacttctttctacacagacacagtaacaatctgatctctcttgcttttccccacatttcccccttttcttttcgacaaaaccgccatcgtcatcatggcccgttctcgatggtcgctgtctcttcggagctgttgagtacacctgcagactaacaacagacaaaacaggcacacaaggattaatatgagatttataattgtagtacttccaatggtcttaacccaagtgacagggttaagatttgcgaggccatcagcaactcctgcaattgcctcagttcctggcaccaaatttaaatgggcttttgatgcttcgaaaatttgttcttttaatttggaaatgtctaaagtgagattatcttctcttccctgtagatggcgtctaaccatgtcccagtgatgctcagagtcattataaatttggggtgtaatacaaaaatctgacgtattccagtcacactgtaactggaaacgatgttctaagctcatgagtctgtctcccatccaaatgacagtttgtctaagatcattaatttgatttgccaatttttgatcaatactagattgtgaattccacaatcttgtagaattcttttgcccatcattaacaaagtttactgactgaacagaagagtgcaatgcaactcctgctacagcagccgtagctgtgactgcaattaatcccataatcactgcaattaaagtaaaaatgaatcttttggatctatttaaaacaccttttaatacttcagtcaaaatatggacggatggtgaggcctcccatggtcggtccatggacacagggatccacacgccctctcttgctctcaccagcagaatacggtgttgccaattaaaagttgaatcaatgcaagtaagcaatctacaattttcacaggttatagtctgggagtctggtttaataactatatttcctacaactagcatataagggggctttacgcaactttgtaaaggaagtgttagactggaatttaggtcgacagtataaaatggcttacgatctcttgtttctaaagtttgatttccagaccaaattctaatgtggtgtgaggccacagtaagcctccataattctggatgttcaggaccagaaacaggacttactatttttggtcttggggtagagattcttttttctccccattcccaagggtagaaagactgcaattttttatgcttatgtttgtctaaactttctgttaagtcgctatcaacagctggactcacttgtgcacttggacacgactgagtttgtcctgagcaattgtggtagaattgacctcgaggtgcccaatctataatagttccaaattcattgttttgtaatatcaccgcactattggccacacattcttcccaaactaaaacttctgtattttttgattctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcaaataggaggataacgatacccaatggaaatatttatcatcatcccttcttcctcaggtttggcagggcagcgatcatctatggggccaggtacccatacactatcattaacatatacttctataggattatccatccatgtgactgcccgaattaagggcgggaaaggcacataggcccagttggtatagttagctacagctgctcctgcaggcatagggagacttaccaccattgatacaatcatcaaggctgcaagcagcatactctctggggtttgtgtcacctttgtgttctctagatattttgtagctaactgcgtcagcttctttagttgtgcccaagtcggcggctctgccttcttggtggatggcaacttcatctgttcttctgacgtcaccattttgttcatcttgtgagtcaacggtgctcgattgcggtgtctccgtctccgcggaggtgcttttctttgcatctctgatgggttcattgtagaacttcaaatgtctagtgggtatccaaacaggaagctgattttctcctggtgaaacacaagcaaaacctctcccccacgttatcaccttccctatttcccatgtcttatttttattatctttccaccaaattagttttccttcatgtgggctgttctttttaccagtaagatgttgttctgcagaagtagtagtctgatttctataaatgtttaaaaaatttaaagtatagagtgctagattaagttgcatctgaggagtggtacactccttactgtctcccccttctttttgtttaactaattgagttttgagtgttctattagttctttcaactatggcctgtccttgggaattataaggaattcctgttgtatgtgaaattttccactgacttaagaatttttggaaagctttactacaatatcctggtccattgtcagttttgattttttctggaactcccattacagcaaaacaagacaataaatgttttttaacatgggaagtactttctcctgtttggcaagttgcccatatgaaatgtgaataagtatcaactgttacatgaacatatgataatcttccaaatgaaggtacatgcgtgacatccatttgccataatgcattaggacacagacctctgggattaactcctgcctcttgagtgggcaggtgtaagacttgacactgggtgcaatgttgtacaatatcttttgcctgtttccatgtgacatcaaatttgttttttaatcctgctgcatttacatgagtcaaagcatgaagttcttgtgcttttatgagtgcagatgataccagtaagtcagcttgttcatttgctttagtcaaaggccctggtaaattagtgtgtgctcgaatatgagtaatataaaatgggaaatttctttttcttacagtttgttgtaataaattgaatagctggtttaactgatcatccatgctatatttaattagagctgtctcaacaacccttgtagcctgtactacatatgcagaatctgatataatattgataggttggtcaaaatcttgtaacactgtaatgactgcaaccaactctgctctttgagctgattgatatggagttttgattactcgttctttcggccctgtgtaagctgcttttccattgctggaaccatcagtaaatactgttagagcattttctaaaggttcacgtctggtaattttaggtagaatccaagtagtcagttttaagaactggaagatctttgtttttgggtaatgattatcaataattcccacaaaattagcaagaccaatctgccatgcaccagaattgataaaggcttgtctaacttgttccttggttaaagggacaactattttgtctgggtcatttccacataattttattattcgtaatcttgtctgaccgattaatgtagctatttgatccaagtacagtgtaaaagtcttaactgtactgtgaggaaggaatgaccactccacaagatcagtattttgaataatgatacctgttggagaatgtgcagtggcaaaaatcaaaagttggagtggggctaagggatctattctatttatttgtgctgactgaattttttcttccactaatttaatttcttttgttgcctctggggttaatattcttttactatttaagtctgagtctcctcttaagatagagaacaaatttgacatggcataagtaggaatgcctagagttggctgaatccaattaatatctcctagtaatttttgaaaatcatttagtgtttttaatgtgtcttttcttatttctattttttgtggcttaatttttctattttctatctgcatccctaaataatgaaaaggagtagaggtttggatcttatcagatgctattgccagtccagcactggcaacctctgcttgcagaaatgtataacagtcaattaatttatctttcgtttctgcagcacataaaatatcatcaatataatgaataatataacagtctgaaaacttttttctaactggttgaagagctcgacctacaaaagtctgacaaatagttggactattaagcattccctgaggtaacactttccactgaaacctggtggctggttctttattatttatggctggtatagtaaaggcaaatttttcgcaatcctgctctgccagagggatggtaaaaaagcaatcctttagatcaattataattaaaggccaatcttttgggatcatggctggagagggcaacccgggttggagaggccccatgggttgaattacggcgtttacagcccttaagtcagttaacatacgccatttgcctgatttcttctgaattacaaacacaggagaattccaaggtgagaacgaaggctcaatatgacccttttctaactgttcatttgctaataaatgtaaagcctccagtttttgttttggtagcggccactgatttacccacaccagtttttctgttttccaagttaatggtatgggtttcggaggctctatagtggccacccctaaaaaggataccctattccttctcttttttgatttattttagcctcaaatggaattttaatgccatcttcatttttccctagtccctttcctggtatatatcccctcttggtcatgattttttgactcgtggggctatataatggagcgggcatggtgatttccgcaccccattgttgtaataaatctcgaccccacagattaagaggaattgaagtaatcattggctgaacagtactttcttgattatctggccctaagcaatgtaaaatctccatactttgatacacttctgaggctgtgcctatgccgacaagtcctataacagccttttgtttaggccaattttttggccactgatttaaagcaatgatagagacatctgctccagtgtctaccaatccttcaaactgttttccttgaataatggccttacacacaggtctgttctctgagacctgacttgcccaatatgcagcctttcctgttggatcagtgcttccaagccctcctattctttttatttcactatttccacccttaatatatggcaggagtaataattgagcaatcctgtctcttggactggcactccaaggaattgaagagctaataaccaattgaatttcgcctttatagtctgaatcaaccacactagtatgaatttgaactccttttagatttagacttgatcttcccaagattagtcctacagtcccctcaggcagtgggccatatacccctgtagggattttttgtgggggctcccctggaagcagagagactgcttgtatagtacataaatctactgctgcactgccgcttgtggcgggggacaattgttgtattgtggtaactggcttattccctgaaacacttgggacagtgggggttgttgtcctgaaaaccctgaggaacaaatggctgaattgggaatgccccagtttgttgtggggcctgaggctggcccctttgctcgtttcccgacaatggttgcccatttttatcaaatttagaacgacattgactagcccaatgttttccttttttacatcttggacataagtcaggtggctctctacctgttgtagttgcttgaatagttatattctgtttgtttaagactgggcaattcttttttaagtgaccaatttgaccacaattataacattttcctccaaatgttctaacttgtcctcctaaaacaactcctgttattgcttgagccataagcatagctttatgcatagctcctccgattccatcacaggcttttacatattctgagattacatctgatcctgcaggaacctttccttttaatggcttaatggctgattgacactcaggattggcgttttcatatgccatcaactccactatgaccttacgggctttttcatcggcaattgacttttgagcaacatcttggagccttgccacaaaatcaggatagggctcttttgaaccttgtcttactgtattaaatgaggggcaggtacttcctgggtcttggattttttcccaggctctaaggcagatagctctaacttgctcaatggcctcattttgcattaatgcttgttgactaatagtactccaattttgacctattcctaatagttgatctgcatctatgttaactggaggattggcagccctatttcttcggacctgttcttgtaccccatcaatccaccaagtcttaaattgtaaaaattgagagggtgagagagacgattttgccagaatctcccaatcataaggaatgagtctatgtccatgagcaatggaatctaataatgtcctcatataaggggagttgggtccatactgttttactccctctttcatatcttttagcatttttatcgaaaaagacttgtatctggcctcaactgtgggaggctctccctcttgggctccttctccaggtggcatcggttctaacgttactgggaattgccatgcctcagtatctccttcctttcttgatttatcaataatttcatgtaattcactaccctgtctactaggtggtgccgtaggattaagtctcctagtgggcggctgagggtatggctccctgccctgtggtgctgggggcattcctggatatccatactgactttctgggggtggccgatactgaagttcagccggaggccagtattgataggctactggcggttgggtcttattttctttaacctgcttttgaggttgtaatgttacgggcacctgacctgctggaagaggacttgtgcctcgtggtttagactctgatggccccactaattctggaccttttccttctaattttaacgtttcaggatatatcacctcctgtaattgattatagtcaacattttgcgttgactgagccattaccggctctgctacatattcgcaatgtaaactttccgtttctttctgggattttttccttgtgttttcattacaatctattaaacagcttccaggggcatcagaaactgaaatgctatcttcttctgtttgaaatggttctaaagctgctttaataatggcccaatcattccatactgtaagtggaatgatattacccttcctacctgcttgttttagttccttaccaattcttttccaatcttttagatctaaagttccttgttctggaaaccatgggcaaaattgttctattatttgaaatagcttgattagattttttgtagatactttaactccccctctttttaaaagaattttaataaagctgagataagaggcatatttacttttaattttacttttagtttgccccattatcaccctagcttcttccgagcgcacaagcttaccgtaaggctgactgtagacgtactcgggatctctcgtcgacttgtcctcaatgaccacgctcgagcgtaccttcaccctagagaaaagcctccactttgggcaccagatgtaggggtgggttgcccctacacacctgtgggtgtttcttgtaaggtgggacgagagatttggaaaagaaaaagacacagagacaaagtatagagaaagaaataaggggacccggggaaccagcgttcagcatatggaggatcccgccagcctctgagttcccttcgtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtatcgggctgggggacggtcatgtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccatttaactctgagttgacacagcacacatttcagagagcacggggttgggggtaaggtcacagaatctcaaggcagaagaatttttcttagtacataacaaaatggagtctcctatgtctacttctttctacacagacacagtaacaatctgatctctcttgcttttccccacaaaaggtaataaacataggttattaggccaaactatatgagtttggatctcagtgctaatctttataagctgtatgcaccctgtgttttacttgccattctataaatgataataataatagcattgttttgaagatgaataaacttgttatattaattagaaactaacttgttataataaagaatcttaatgatagaatgactgaagaaagacaaaaccttatttctctttcatgtaaaagtccaaaaatagctaagttgactaggtgcgggtagagggttctttttcaccaagttatgttgtgatttgggctgaaggtcaaccctgccatcctaaacagttgaccattttatttggttccaaggatattctaacaggcagggttagaaagtatagaacctgattaagattacatagaagcagctcacatcattccactcctttttcatttttccaaatttgttcatgtggacatatagaaataggaagctaggagctgatgtgattagctaagtattcatgtgtccagctaaacccagaggttctatgactaaaagtctgaaggtaaaactgactgctttgggacagtttaacaatctctctgtataactgcttgagcagtggcaggcacatactctatgctatgttagagtttaccattgttggtcatttgttcttctacttatttttttgttctctgtcctgattcagtattgaacaccctatacatgtatatatatatatatatgtgtgtgtgtgtgtatgtgtgtgcgtgtgtgtctcaactgattgtccagttgcctgataaatttaagtgatctgtagttcacagtatcccaagttcaactttggactattcaaaaatttctccttaatttgagcagaaatctaagcccctgcaatttctttccattagtctttgccttaacttggcactaacaaaatatattccacatgataatatttcagatatatggcagctaatatgtactgtttctcccccaaagttgttatttccaggaataaacattactccttttgagaagaactgctacttcttccactattgtttcctaagaatgtatcttaccaattaaaaaagattcctgttttgacatattttttcctcttcaacctaatctctgttatgaatgaacacacattgcctatgtctctctaaatttgcttgccagagctaaatacacgattccattggtgttctttgcacagtaaattgagaaggactagcatcatgttgtttatctttctacctaaaactgtgagactccgaaatcatatgccagggcatatgatctactattggcctgcctataatgtaacagaacaatctttaacttttgctataaatcagagactatttggatacaggggaaaaaaaatctgttggtaaggatcgttcattggaattagaaagtattttgtcatcttccttggaagaaacattctgtttctgtacaagctagatatgattttgacatatgaaaatcttttctgtttttttccaattggctatttaataaggacattgattatattgtaccaggggtctgagctcagacatgactgttcagataacatctgatttttctaatttctaggtttatagtctgtgtctctaggagttatggtaatgaggaagtctgaatttggcctgggcgatgtaattttatcttacagttactaattactagataactgaagacaaattgctttctttacttagccaggacagcaattcatagagcactaattagtaagagaatggaaggtcactgtgaagccgaatgtcttacctttgaagtaaagattgggggctgtagagctgaattagcaccattttgctgcaaaaacagaaagaaacattaaaaactaagcaccagctgcaagaaacaaagaggtgaagattctctggctgcgatatcagtgggataaatctctctggaccatctctctttgatctgcaaaggttggattatctgaagccatgtctgtccagttcccagtgctacaaggagatacccttcctaggctgtgaacttcttccaggcagacactatatcttgttgacctttgcactctcagttcctgacacagggcctattaatgatttcttttactttatataaatgtgagccattgaatacacagataaaacagatggaatggaatggttggactggcactcaggtgaattgagttctaaagtcatagctctggctttaaacagatgtaggacattgggccctctgtgccaggattctggtatctataatgtgagcagattgaacctctcagtaaacggaatacctgctagatgctcattgtggctgcttcagcagtatcactgtcatgtactcctttctctcttttataggtaggaactctttagattcttgttcatttacctgttcgatctaaaacatcaagttttagaatgaaatgcacccatatcaaaattcaagttggctgtagcttgagcaacatcttcattctggccatttgcagtgagaattgatcaaatcatgggtttctgaagcagtaagttccccaaaggtcatcgaattcagtgcccttattacaaatgaggagagtgagactgaagaagattatacagttactgacttagtcacatttatattccaacttcgggctttctggacttgtctgcttagcatgtccacaaaatagcaggctggaagataatagaacaacaaaaggcagtcctaaagatggaacgtttctcagcgggttcaggtgaacagttaaatggaggaagaaattgaaacaaactgaaaaaaaaaaaaccatagaaagaaaaaaagacactttctaagaatctcttttgtaatcctgcaaaccctgccctttcagagcataacaatggcaaactgaggcttaccttttccctaatttgccaaaatttggagtcccagctttccagcagaagaaagcatatatcacagaccatttcatcgtagaagatttatagtacaccatcccagaacagaagaagtaaaatccctctgcgctgctctagaaaatgtccttctctattcagttaagctggcttcctgtagagatgtaaataaaagaggaaaaaaaatctggaacaagacaacgtgtaaaatgttttaaaataaaaaataaaatgtgttttgaaagatcttctggtattgccacttgtcttcatggtgctaattttcttattctgaaaactatgctggaggaaaatatgtaaagttatctgtttcaatcagaggatttttctgttctgcattttccctagaaattccttaaacattgtctcagataaaactaactgcctttgagaatctaagtgtgtttagactttctcgtttcttcattttttatttttcctcttctttctctgtcagtcaaatgacttgaaatatagcatacatttcctgtctccagtgtttttataccctgtttccttctcaacctatagaaatctcttaaagccaggcatggaggctcatgcctgcaatttcagcactttgggaggccaagacaggaggatcctttgagcccaggagttcgagaccagcctgggcaacatagggagaccccatctctacaaaaatttaaaaatttaggctgggcacagtggctcacgcctgtaatcccagcactttggggggccgaggtgggcaaatcacaaggtcgggagtttgagaccagcttgaccaacctggtgaaaccccgtctctactaaaaatacaaaaagcagccaggcgtggtggcatgcatctgtaatcccagctccttgggagtctgagacaggggaatcgcttgaacccgggaggcagaggttgcagtgagccaagatcatgccattgcactccagcctgggtgacaagagcaagtctacgtctcaaaaaaaaaaaaaaagaaaagaaaagcccggtatagtggctcacacccatagccccaattgcttgggggctgagccctggaagttgaggctgcagtgagcctgatcatgccattgcactccagcctgagtgacagagggagactctgtctcaaaaaaaaaaaaaaaaaaaagagaccctgtttcaaaagaagaagaaggagaagaagaaaaaagaagaagaagaagaagaagattattttagctctcatcatactattggaatttctctttataaaggtaccaggtacctccttagtcagttaatagtagtttttctcttaataaattaccagggccaactccagtgacctatggccagtattcatccttcaggccctttctgaaacattttacaaggtgatctatctcctgcaccttaatttctctctcttctggccgtgagaatgtttgtctgctggacatttctctttgtcttctccacacattctcagtcttctttgctgactgttcctcatattctcttggctaggattgctttcacctatgtttcattctcttcttattatacgtgttatctccaaacaatctcctccattctcatggttcccactctttatggactaatgacatggtgttacttctttacttttatgatttctttactctgctctgtggtgctgtgctgggactctgaaaacagcatttgttatactgcttggccagttagcttcttgttagcacctttaatgaaaggtattagcaggagagtggaaaacaagaccaagagtgaaggcatctgttctatgccgtttttgtcagccccattccaatagcagcagatggttggctccaggcttcaggctttatattctttccactttctcagcagccccacaaatatgccagaaaaggaccagcagcatcctagctctacctccttggttctaagaggaccggctgagctacaatctgcttttctatgcaccttgtctatccaagcacctgttggaccatgtctcctcctcagaagtctgaacactggctatcaagtgcctctgcctcatttgcctgcacatcagtcattgagcattgctcccttcaaattttaagcgtgactgatgtggtgtaacccactaggagacatgggcacctggtactgtgtctcctcctcataggttcaagctctagctgcgtacaagtaagataattttgggcgctagcccatgagagtaactttactcctttgttcctatatgttaaaaggcgatatcccttttgtatggttatctctgtgccttttcaaccttccattacttgtgtatccaatttaagtttactgagctactctaagtggatttctgataggcacttcaaaggtaatgtctttattgcaatttattggtttgcttccaaatctggccttcatttaatattctaaatcttagaaaatattactatcgtttacttgacattcaggttaaaagtagaggtttactcaggaatgcttacttttctgaataagtcacacaatttactcatgacattaatctgcataaattgcttattaatccctgtaaatcttaatgcaattatctccttccctctttctcctcactgatgttgttctagatcagtgtcttattatcttcagcctctgctcttactctgtcaaacttggtgttaacaaattcatcctcactgccaattatctaaaatttacttataatttgtggattgaactttgcatgaagtaaaggaatagttctactttttcatgatgtatgagcacacacacgagcatacacacacccatgtgaattgaaaaaccataaaaattagtctaagatttatattcagatgtctacgaatccttagaacactcaaatattagaactagaagtagccttagagatcacttaagtccctgcttccagaactatattggttaattatagtcagtgtaactagcctagaatacttataattagagctctatgccccactctaacactttcaaatggggatctcttcagaatctaaatttgtaaaatgacttttccaattaagtctcctgcacagtgacatttgagacctgttgatcactgaacacagaagcatctgagatccattgatctctgtcacacacctccagttagttgcagaaatagattcaggctcaaatccaggattgctgccttcatgtccagtggcatatcactgtgttgcacttttccatttgtaaaggaggtatggagagggcatgaccaagtggttcaccttgctcaaccccaggaacagaagctcaaactttattgggtagacagacacatgtacagcaaatgaacattccatgtgttaagttctacatcctgatccgagacctgtgggagtttagaacatgtgcatttagactaattacgactggagtcactggggtccagagaggtttcacagacaaaatgtcctgtgaccatttaaaccaactggtttatcaacttagcgtaaatcactttaactgaaactgaaggagtattgctgctaaacttcctttgttgccaatatatttgtagtttatgttcccatttgacaattatttccattcaaaactgctcactttcattcttctggggaactgaaccgaaaatgttaaggactctctgttctcttatgaaagccattctgctcatatggtgcacttctgtccctgattgtctatgtcgaggtatagaaaggtccttttcatccaaacaaagacattccactggcccaggtgagctgctgaccaaaatgaagccacctatcttctgtctctgtggacaccttcacctgtgaggactattatcattctcatttgccacttaatttttttcccatttcacttttttttttttttttttcgaaacaagtctcactaggtggcaaaacaatctgtggaagccttgacaagtttaatgaaactgagaccttgagggaatcccctgggcaaaatctccactatctatatgtggagaaggggctgtatgagaaaccaggaaaactgatgacagagagaactgtagtcttctaacccgtgcacaagcccttccggctgtgtgaacagcagagcgggccaggtaaaggctgacttagatgaactgcagtaagaggtgctccaggtgtctggatccacctctccttcatcactgaaactcaacaggatctgagtagtagaaaatggggcactttcctgatttttttttttttttttttttttgagacagggtctcattctgtttcccagtctggagtgcagtggcaccatcatagctgggattacaggcacatgcccccatgtctggctaaatttttttattttagtagagatgaggtgttactatactgctcaggctgatctcagacacctgagttcaagcaagcctctttagtgattttaagaaacttacaagagagagctatgacaaagctctgttgacccaaggcaaacagtgtaacaggctgacttataaggatcaccatcaatcttagcaacctaacccattgtccttcaatactgctgctcttctgggcttgactctgttcctatgactttattccaatccttggctgtacctctttttttttttcttttttttttttggtcaaccgctggtcttttcaaatagaacttacagagatcaaaactctcactctgaaactgagtgtactccttcacattcaaggtaggaacaagaactacaggtataaagtcttctgcatggacaggctttggagcagctctgaatcagactccctacctttgtccaaggaaatgcatgtgcattaggatcagatcccctctgaggaggtagggctggttatgcccaggaagtgatgtggacacatgttgccttatatacactgcattgcattttagatggaccatcttctcatcaggacttcttagtgacccaatcaaacagccttcctacaaccattgtgctttggtagagttgtagtttcttctggaaaagctaaggaaattttctaaggtaggacaggaaaatcttgttttagatagtaatcataaatcataattttaaaaattatgcttcaatgtattgtcatttttttcacttcacttctcagctttttttttttttttttttttttttttttcttgagacggagtcttgctctgtcacccaggctggagtgcagtggcacaatcttggctcatgcaagctccgccttctggctcacgccattctcctgcctcagcctcctgagtagctgggactacaggcacccgccactacgcccggctaatttttttgtacttttagtacagacggggtttcaccgcgttagccaggatgatctcgatctcctgacctcgtgatccacccgcctcggcctcccaaagtgctgggattacaggactgagccaacgcgcccagcccactcctcgtcttttatcagatccattttctaggcatggaatcagagactcagagacacagtgagcagaccttaatttacccagacattcatttagtgggttagtttctcgtaaggggcttccaaatgtagacaatgtgtgtcccgtgcagactcaagaggaatcaattcagtctatttgaagactccccaaactcatattttgtagaaaccaaaaaacaaaatatttggtagagaaggtcgaagtgtctgaacggtacatacaggcagagctacattacttggctcctatgtgaagagagagggagctgcagaaaaactaaatgggaaggctcagatgtatgaatttcttcaactgaaattgcatacaatcctggctccttaatctgtgtccacttcccagcagttatgggaggtatgagctcagctcaggggaaacaaacttaacaaacttagctctggaaatctggagaagcagtgagcagggctgatcccccaagtaccctgatgaatcccagtgttctttctgttcaattacctaagggaagctattcaagttttaagtccgttttgaatcaaaatattgattttttttaaaaaaaaacttaaaatttaaagaaactggtattagttatgggaaaaccagaagggtaccctcatttggaaataatctttgagaaatctttgcagtgtgaacagttgggatttggtctttccaaaatccagctagcatgcacttaagaaaaaggaaaatcaggaaatgtagaaaatgaaatgctaacttacatatttcactttaacatttattaaggatattaatgggcctattgaaaattgaaaatgcagttttgctattttaaaaaatgttcttgtgtgagagtagacatcccttggtaaatgtccatggaaatattgaacatttaatttttcattagttctaaacaaaatcatgtatttcctaaaaggtacgcattttacatgcctcaatacccatagttgacacaaaatactctgaaacagaaaacaaaacattaaactatcccatattttaaattaaaaatattttttcaaacagcgctgagaacactgaaatatgtgaaattacaatatattctaaaacgattacctaagaaaattaggggatgtcatccacgtttgtctcaaaggaattcagatttatgattcatcttaagaaatgtgaaaagaacacattaaatataaagatggataaaggaatttattaatatacacagtaacttttgttcttttaaagcaatgattcgggcctcctgggcccagctcaggtcctggcccaaaaagtccctggaacagagcccttgcttttgtccctgcctcccgggtgattgaggagtagaaaaggaacctacattcctcatccttggtgtgaatttccacgctccccaccggccaactgtggcaattcacattgtagttctgacaataaatggcccgttctgactgggctggtgggggtcctggtccagccacctccagccaggggtccctgggtcgtgaaggcgccacgacctgctccactcaagatgtgcagctccacccactcacgctagagaggaagaagaacttctgccataaacttttgttgttattgttttgtttggtttggtttgagacggggtctcgttctgttgctccgcctggagtgcagtggccccatcacggctcactgcagcctcgacctcctgggctcgagtgattctcatgcttcagcctctggaggagctggggccacaggcacccaccaccacacctggctaagtttttgtatttttgtagaaacaaggtctcgctctgttgcccaggctcgtctcaaactccgcccacctcagcctcccaaagtgctgggattccaggtgcgagccaccgcacccagcctcctaaactgtttttaatttgtgcagaatgaaccgggtcatcaaccactgtaagtggtctgactaccctgaccataaaatgtcggaaacactcaacttgcaactggtggaagcagcctagccccactgcacgtaaaacactcgcgttgtggcaaacgcggagaccaaggctgcactggccggaagtggggacagatcccgatacgccctggggacagagcagggatgctgaggcctggtccacactggctctgccctctttctggcccactaccccatcctgagaccgcaggttccggcggacccggatgcaggttttccggatgaaaggcccctttcctggagtggactttgatattttctgttcacaactccgtgtcaccatcctccacacctaggatctggcgtctggtgtcactgccgacgtcacaatccccgcacctacgtgtctcagccgcagtagccctacgtcgctgtcagacactgggaggttggtgccccgccatgcttttgtgtcttttgtcttttcaccctctcccctccccacccagtgccccgtctaagtccccactcggaagtggattctcacccctcgcggccctttgtgggcaaagccaggaggaggaaggccacaacctcccgctggctttgggatttcttagacatcagtagtcttctaaggccctccaccctgcccgcacccctccttcatcctcgcgtctcttgggacactgccctgctgccctcaggcctttccttagtcacagactcggggaggcccctgaaccccctcggcttggacatcaccggccacagtcctgtgacgccctgtgatcttctgtcccagatctcattccactggctgtgcctgtcagggtgtgcttagattttggagtcccagtgtaaggcgtgctcttattgggaagggggcttcttcattctcttcttgtgaatgtagatgtgaagccagggcataaggagaaaaagagaggccaaaagagaaccagagagccagggagctagggagagtgaggttgaaaaagaaggtaacgttgagtattgggaagctgtctctgatggattttgaaaagcagtgatagtgaaagagttctagaagctttgtagaaggtgttgaaaaaaatagtgaaagttacgtgggcaagaaatagtgggatagatgacacagacaaagagaatcaggagagaggtggaggacagaatagaaaggggattctgaccaaccacagcagaggagtaaaggaaagagatccccaattcattagggttttttttaaaaagtcttaataatattctcttttgtttcagattcagatgatgaggcctctttagatttttagtctttattatattttggaaatatcttttagtacttagtattttacactatttcaatgtgctcttggaaagggtattggtttttttatattaacagtcaaaacctagtttaatcagtaagtctattcttctactgtctccattatttccttacatggccttttaactgggtctgtaaaatacaattttcagggaagtgtatgttcccttgacctctctctgcaaattttcaaggatgggctgaagtgatcaggaattttgttctagcagagccattctgttcatgattactaaattgctcagagctagttcaagccaataagtaggtatccttaatttcatatttttgataattcaatgagttgttctggaaaaaaaggaattaaatgcttgaaatcagattattgtgattaaaaccatgagaaagaagttgctcttgctccagagcatgaaatatggtatagaatctttagggcaaagagaaggaaaaaccctatcacaattcgtcacagcacatcattcttgtgaagctagtggtggttactctctactggcatctcctactgaccttgcctgccccaagacccaagtacagaatgacaaggcagcttgatgaggggagagtcaagactttttaaactaactacagaacaaaattatctctccaagtaggaggggacacttggtgctataaatgaatataaatgacatgagaatgacatgagaatgaaaactgtcaatataataaatagtttgcaaaagctctaacttaaaacacacaggactttcagagtagagaattcctagctctgtaaagaatttgggactccatttgagagaagccttggtctctactcactgtgaaccaacattcagccaggtaccaccgttggtatgttaccaaaaaaactcagtaaaaaatgctttcttaagaaggaaataggaaaggaaagtctttacaagggcaactgatcatcttgtggattaccaaatactgcagatttcaggtcagaaaacggagtcatggagaataaaaagaaaaaactaacacacaattgagcaaataattcataatttagagaatgtatctactcattaaaaatgtgaagtgtaaatgtataacagttatgtgacctgggaattttgaatacaaaattatgtaagcaactttattattttttaatagaaaaatacttgcaaatattgaaacaataaaacctgttgctgaaaaatctaatatgttgttaaagttctagttttatttatgcaggtctgacacatagatttgcataagctatccttagcatgtgagtagagatttcatccttctcttcccgtttccccatcatcaacagcttttttttcttcccacagccaaactcccttcattccaacttccaccaaaaccacttctctggatccatccctggagttgacacaacagggatcttcagccccaggtgccaggtttctcagtgatccattacacagatttaacagggaaatgggggcagtatcaaaaacacccagtataaaccattgaattaccccagcccttgtctctgcccatgaacaactgcctggggccagagaattaggcatccctgctcttctttccctcagaaagcccttgagacgttctccttgaagctcccctaggtgggagtagaagttcatctcctgacactccacgttttattcatgagtcctgagttatgacacagaggacacagttgtgctccccttactatggactagcagataaagcaccttaaccactcagccaccatgcaaacccttcttatatttgattcaatatacttttccgcaagcaaaataaaagttctgaccaaggaggcgtcgtctgatttgactctagaacttggaaatgcattggcttttagcaaatctcagtactgaatgtaaacttcaaggagaaatggttccaggaaataaattgggatgacattgaacttttagcaaactgcaaaatcctgaaaccatggacttactgaggccaattaaatgggctaattcatgggtggaagtggtacatcctaaaaattctccacaagtgattctacactgaagccagggtttttgtcaagtactgtgtgaggatgaggatggccatctgcttggcaagccatctggtccaggcagggctcacattattgttcacagtttaacctatttaattaaatagtaattttcccccaaatcttatatgacataagctgtagtcctgagccacattaagatgtactatttatgcagtaaaattgtatgggatttgacaaatgcatagcagcagttttccagcattaaagtatcacagaacccttctcttattcaagctcctcttccgtccacatacagggaatcaatcgccttttgtatatggtccttggacgttgcttctttatttcagttatcttccatcaaagcaaatgataccgtgctctattttcatttgatcctccaaaagaaaggtactgaataatctaaaccagaatttcagccattcagagacttaggtccatcgctaagcggtagaagccaagcctcttgcgctgcaaccccatggccggcagagggcgagggaacacgccgtcccgccctccggggcgcatgcgctttctgcctgcggaggcggggctgggtctccaggaagtacgtgagtttcctttcctctggtcagggaggaggcgccgccctggctttggggcaactaaggcgatgtccatcaggaggaaaacttcctgtccgcagccctaactgctgagaagggagattcgctgcagagtatcccggatatttttctgaaacagccataaagacttcattttcagggctgttgccacgtgttttattctgtattttctgttgggatactttagcattattttacaaatgtataaatttggggttagggagggctttctgatagataatagaagcaggctgtaacatgtcctccctgtgacctcattgaggattgattgtgaggagaaacaagaagaattgtgaggaaaatctacagaatacggggaccctgcagaggaaggggtcgggtcagggcagggccacacaatttcagtgcagcccgtgggaaaggggcccttgcagggaaacccgcgctctgcctccgtgcatttccacattgtgaggggctcatctttcctacagtgctaaagtcactgaaaaatagacaatgaaagagagggacattaattcaacattcagttgttgacgataaagcattcagaaccacatctttctcttcatcacagcactgcagatgtaaaaaatggttttaatttcaaaggcaaggggaagaggtacacttgtgaacaagtttggaccccaaatgaaaatatattgcttaaatatttcttcaaaaataagtcattattctgtgttgcaggatatatcctgagatttttaagctataactttattaatttattggttaaaacacattttgtttatagccaaagcgattataaaggtagaatatttggcaagtccctcatatttttcttcttctactaggttttcagctagaattgacacacacaaactcacaatgaggggcctctttcttgaccataaaatatgcatactccagaaccctcagtgtaagctgtttcttgaatatcttaacctgatccccacaaccagagagaatgtagagaagtaacccgtttttttttttttaaacacagtctcgcactgtcaccaggctggagtgcaatgtcgtgatcttcgctcactgcaacctccgcctcccgggttcaagctattctcctgtctcagcctcccgagtagctgggattacaggtgcccgccaccacacccagctaattttttgtatttttagttgagatggggtttcactatgttggccaggctggtctcaaatttctgacctcctgatccgcctgcctcggcctcccaaagtgctgggattataggcatgagccaccgtgcccggccaagtaacccaactttaaaactacatctggttgggcaccatgactcatgccggtaatcccaacattttgtgaggcggacatgggcagatcacttgaggtcaggagtttgagaccagcctggccaacatggtggaaccccgtctctaaccaaaatacaaaaagtagccgggcatggtggtgcacacctctaatcccagctactcgagaggctgagacaggagaatcgcttgaacctgggaggcagaggttgtagtgagccagactgcaccacctcactccagcctgggcaacagaacacaactccgtctgaaaaacaaacaaacaaactacatctgatcttcagcaaagtatctgctgttctgctcagaaaagaccgaaatccacaaagcagacagacctctgaataaagacactaaggtccgccgtgggcgcttttaagaagttagcagggcctgtacttcacctaataagactgaggaggatatcagctaaatggaaagaatctacaaacaaatttatacaatttctagggagagaatgacatcctgagctcaagggcctgttagtgacggcacattcagtaatggtgcagcctcacagaatttccatttagttcaattttggtatttactggtcatcttttctccccattaccatccaaccttttttatgttgtcaaataatttttaatcataaaatgattaactctgagtttgggcatttggtgtctggcctcctgatggaagtttaggtgactttgtccatggaaatcatggatttttaattaataagtaatgttgaaagggaaacttgcattataattctgaaaccattccagtgggggatacaggcaagaaataagccaacagacagattagcacatagtgatatattagaaattaagtaaaggtccttttggtatttttcccagctcatcttatgatatgagcctattatgtttggataactttccccaggagattcattttaaaagttctttcacttaaaatacatattattttattatttaaaaatactgtcaccagaagcggtggctcacgtctgtaatcccagcactttgggaggccgaggtagatggatcacttgaggtcaggagtttgagaccagcctggccagcacggtgaaaccccgtctctactaaaaatacaaaaattagacaagcgtggtggcacatgcctgtaatcacagctactcggtactctgaggcaggaaaatcacttgaacccagcgggtggagcttgcagtgagccgagatcgtactactgcattcctgcctgggagacagagtgagactccatctcaaaaaaaaaaaaatactgtcagccctccacatccatgggttccagctccatggattcaactaaacttgaatagaaaatattcagaaaatatttacacaatttccaccccccgacaaaaaaaaatttgaattttcccttcaccaaattctttgttgagaacacgtaagtaatgtaaggtctgggcattgtattaggtattataagtaatctagagataatttaagctatatgaattaatatgagtaagttacatctaaattctctaccactttatacaaggaagtggagcatccacaaatattgttaccttcaaagtttcctagaaccaatcctttatgtttacccagaaatgattatgcacatgaaacttacagaaaataattgtctttcctaattaatgaatagtatacaatagaatgtaaatagcactattttaaaatgctgatattttatatcacatttctatggtgaatcagagtagaggttacattagactgattttgattagattaggctaattctaacaggggcacacccatatcacttgagttttgataaaagcactcccatgcaggtcctactacttaatcagcagcactagccaatcgtgttcatccattttgataaatcccacagctctctctattataaaacttttgggatttgcccaagatttcattctaccatagcgtcattcaacctgtcccaggccagggcacactattccatgttctggatgtgccgagctgatcatcttcttcaggaaaagtaaaagatcaagtcatagactgtatagatttataagaaaataagatgaagattgaaattttctgatacaagtgagtctagagaacctttaccatgtatggttactggcgccaaagaagccttagtgattcctggacagaatcgcagaatgacaatgaaggagagagcaggtatgttagtgtgtgtttaccttgggttgccaggaggttgccatgtgactatgtgtgactgtgtgcatttgtgtgtgtgtgtggtgtgaatgtgtgataaagggtcaaactagggcagagaaagcaccctggcctgccatgacattgaacgttataaatttagaacacctgccggagacatgagacccacagtggaggccataggatcctgccagcatggggggtttctggacctgtcagggggctcatctcaggtttcctcccactgtcgatctatgttccctctctaaatgaaagtcacctcttgtgcggagacaggtaaactgtgggcatgatctaaatttcttccctgtgctcattagaaaatgaaacatttcccatcatctctcactccattcacactgtaactgcacagacacggtgctcagatacctgaaataacaacgtcttccctgaaaatcctcagaccaaattagatgtcccttctcagatggatgagctcctgagaaagcaaactgtttcctgtggtcaccatcccttatcacacacattcaccgataggaaaagccattagaaaagttgaggaggggagatgagcattaggacttactggatgcaggtaggatttggagcccaacacaagtgcacttgactgagggacacagaaagaatgtgtgctggatgataaatggagttttgggcttgtgagaattagactctgtgtggaagactaacggatccctttctgtcctgcagcttggctaccacgcaaatgaatccacccaaacgtcaccaagtggagcagggtaccagtataggtaaggcaatttccctgatatttcttaagatctccctgcctggaggtcagtgtcatgtctcacaatcttataaaaggagagggtgctttctgcaggatgagtggaaagtcatgcttgattgatgggggctggtgtcctgaggctggcctgtgctgggttgtggatttctgaaggtcatattctgaaatccaagagactcttgctggaagagccttaacctccctcactgtgatctctctgcaggtgcaaaaacaccctcaattccaggagctccacactgaattcaggccagtccctggaacctccccaggtaagttattatgtcattgcatggcaaagattgcaaaacaccctcaattccaggagctccacaccagaattcatgcccgtcccagaaacctccccaggtaagttcgtatgtccttgtatggcaaagattggacagtgctgcacactcttcaggctcaagagacatccagtggatgtacatttaggtgggtcagcacgagagtcaattctgggagggagtgtattttaaacttgtagagggtgaagctcctggcaactccctccgcatcagcatcatttgcagcctttttggagaatactgacggccatcttttcacgggagcagcaggattccagcaatgaggagctcatcatagtcctagaacaagggacagaagtgaggttgagcctggaagaggtcatcctcatcttggccccagagacagcgctgcagctgaccgtggagaacacagtccttgtgattgttcctggcatatcctgaggtcacaagatggcctgcagtcccctgtgcagatccagtacatcatgccttccattgatgacttcagcttggagtgccatgctcaagatggagacatctcagacatgaaaggagagaatgtgcctctttcacctgcagaagaaggggaggcagcacccctatatcaccagcccttgatgatatccccagcaaaccacaaagctgggatcagcccttttcttctagtaaccccattgtgcattccatgctgtctggcagccttcccccaacgctaccctctaccacccacatctagtcccatgggacgccctagaccagccaactccagtttcagcctgcatggtatggagctactgtgcacctcctccctcagccgtatgcccccttcaccaactcctggtccccagatctatcacagggttcaccataggcctcccagcagggcacagagatgtctctttaggaagtgatttaaccaagagtcaccccctgcattgataggtcagagattgtccaagtccttagtcagtgcattccctgaaatgtggagagaaagtaattccaaggaccgcttgcttcccctttgctgtttcccatcaacacccactgtcttcaacagcagagggctccagatgctgcagggagggggagaaccgcagggagttcaaataaaacattcacatttcacttcacacacaatgtcccttagactttctcttcctatttaaccacatacatccaaccacactcaatcgaatccctgactgctccatgtgagagttctgcttccagcatgatgtggcctgaaaattcatctgaagacagctgctcactcccagggctaacaccgccccttgcatgctgatgtccttgtagtcattggtctgatgccacaataaataattcctaaggctggtgctctatttctgccctgagactctcccctttttctccaagctgtgccccattccttgttttagtccaggttccctacactccccaggccaatgcttttgaataaatcttgacgtcattgaatgaagtagtggtgactgctgtgcttgcttccaactgagacagtctcctgctctcactcatcacgtttccattcacacttgcctttgtttagttttgttttccattgtttgggtttattattcacgtgcttatgaaataactgccacatttctgacagtttttttggccaatttggggcttttcctgtgctcctccttccaagtcctgagtggggtcactgtttgcacctctgggccctgggatgggtctggcttagcaagtgattgaacagagcttggctctgtgtgttcggatgggcacctgcgcttgttcacagctgctcccaggctctccctgtcctgcctgggtgtccctgtgtctctggagtgtctaggaaatctagcagtccccttgagggcccagcacctctttgttggcctgcatgtcccagcctgtgcatccatggccagctagagccaccaccaccttttcctagtcaacctgggtcctggaggcaggggagatgcggggataatgtcctggcctccctgagcccaaccccagtaggtggggagtgctcatgaccccggggggagtacagggcgtttgcccttgacttgcctgaccctctaaaacctcacatgttccctggaggtgggtgcagctttctcctactctggccttgctggcctgggaagagtgtccttggtcccccgagccctcacagcgttttctcttctactgaggtttcaggaactgcctttcccctctgggaaggaggacaggcaccttttcaggtttgattctcctcagagttttgtatctcggctggggcggaagcagccttcgtccacatgagaggcccagccagggcgtcctcaccagcccgggcctccggggaggttttgagtctgggcgctggagaggccccttcctctgcgagagcgaagatggccgccccagtgcagggggcgcctttctgcgcccttagggcgtcaggatccccctacggacgggaagtcccattgggcgtctttggccccgccctcccagagccctgctgatgcggaggtggcgcgggggccctggactctgtcatgagaggtggcagcagaggccaggcagggcccgggctccgggtcaagggagtgtctggcctgggtgggactgggtcccatccagaaactgggattctagggttctggtgcgggtggatccggggcaggctcaggaccaagtccctcttcttccacctcaaggactcacccaggggctggcgggagctccaggctcagcagctgctcctcctcctcctcctcctcctcctccttctcctcctcctcctcctccactcctcccctccccttcccttccccctcctctcgcctttcccctcccccttctcctcctccttctccaggtgttttctcttcttttatttctgtgagttgagaaatggcgccgtccttcacatcggtgtatttctaccctaatccccagtaccttgttgagtaaagcagtcaaactctgcaatatattgaagagccctcaggaggtcctcagaacatgtgcccaaggtagtaagggtgcagcttcgtttacttcgggccaattggtctccataggtataacatcctgacgagggtataaatcaagtgcaacaaatgcctggtgttctatatctaaattgttacaggatttgttaacagtagacacacctatttttcacaccacttgtattgcactatatactggtatgtgtttgggagagaaaacaatgttctttaaaggagaagtcatatgattctatactttcattttgttgtcctttcccacagaaatggccctttcccatataacaaatgttatgtgctatgggagtggatattaggggctaagttggggaaaattagggttctaagtggactgagggcataaccattccccttttctgttttcacaatctgaaaaggagatgggacgccatgtgttatcatgagctgaaatagtccacctatttccccaggggagtatttctgtattgtttacaatgcctgccagttgaaccacagaatacctttgagcctcatttaactttggtgcctatgctctgagaataccatgtttgaggtcacatttaccatccgaaattttccatatgtttggggggccgtgtattttccacaggtgtttggattgtgcctcggcacagatgagtataggccattgcttcatagccaccttagattgtgtttgtaatgaaatagacatgagcccctgttgggttacagaacatgctcattgccaccttcgggtttgagagtatgtttttatgttttgtttggtttctcctatccatttgatgagtgttgcattattttttaaaggagcttcccatccttttccatcttcctggaataacattccttctatgtgggctatttttgacagaaaacttttctctaagagatgcctctcctcgttagctatgaactcagcttacaccaatatacctaggccagctccaacttttccagtgaggtcaagttttaatttctgggtggcgaattttgctggattcatcaggattgctgttgccattgtatactaatggcattagcacaatttgaaactatatgtgcaatttatacttgggagtattgtaccaagaggctttgtcataaggcatctttatcctatcagtaaatattttcttttaaatctatgagaagcagaaaattgtttatggttggggtggatgcaaaagtgacacactatagtctagaaggaaatgtcccttgttttgccggctgtaccatctttgtacccctccttgatttggagagtttgacatggacctaagttcatgcctcaaaactagctcttacaatctcatgtgcctgcctcttccaagacagtccctgagcctagagagagggtgcttgtatagttttagcagcagaagattcgcggtgaaatacagatctgaacccagtgggatgtcagctgagggggattcatatctctagtcttcagaataccgtaattttggtttccttggaagtaaaacaaggagaggtaaataacatttatagtttcacaatcaaaagattatttgtgtgtcagaatggaaaaaggaacctacttcattagggaaccagctaaaaatatggagataaattatgatctggtactctctagaggattattatagcaaagaaataatgatttaatctgcacttaaaaagagttaggactgaaatctagtactaatccttaagcttttccttttaaacaattgttctatctgcattttttttagagattatagtaagaccagtttgtgtgccaagtaagttttagtcttatcatggttggccggattatttgcttaaaatgcagcaagaattgattggccacatagactcattttaagttggctttgctggcaccttacctaaaaatataccactttagttcaagtctctaattgttttaaagactcttattgaaacttatgcaaacaaccatattgtcataaaattaggatctgaattttggagaactcagaaagataatttgcttacaaaaacaaacttcatcaaaatgaattaaagaaaaagattgtctggaccctcctttaacaagagcagtggctttcacacaagatgtttgtttatcatcttggaaatgtcatgcacaagccaaaccgctcctgagagctgtctatcaggcactatgcaatctagcagctcctcacagagttagaattagtcctaggaatgaggctgcctgcttattagtatctcctccttatatccccatgtagcaagattctatgtaaaccatttttattttatcacgaaactcttttggggcaacattatttccactatcatagaagttggttcagttagcattccatagtaaggtactaaatgtccctgagctagaaattcccttgttctatctttgtcatcaggaagaactcacagtttttttttttttttgccatcagccccaataaatgttacacaaagggctatgaagtgcaggatttgtcccgactagcactccagcttctaccctatactttgtgggcttaggcagtcttactagttcccatttggcatgtccaattaacatttctcaaaagagcagatttatatgccttcagttttatactactagaaaggggaaacctctcccaggtagtaaaggaggttacaactaccttacataaaacctgtttaaacattttaaatttcataactctattaacctgtatgtttatatgttctggtcccagaatttttttttaatacccccaaatcattttaccttttctattgaaaaagggtttggtttctcagcagggagttgcatctataagacctctaaggggcagcaaatttgatacgactcctcaaacactctcatgattttgtgggaggagcatccatgtaaaaggggccctcttagcacccaaatttaacataacctgggtaacagacagtttggtgggagcatatcccagtcattattaagccagtccaacatggttcacataagaagcatattaactgctccatctggggtgtttcacttggtattttattgggagagttaggtagtcccctactcagagaaaacagactttatggtggcattttctgggtatattatgctgattattctcttaggaataacctcctgggtatttggatcacatgttagtggttgttcaatagtgaactgtgggtcctgcattaacccaaacaagctcttaaatcgtgtaacatttaaaattaagaatcttgtccttaaagtgttttttctcaatccatcatagtaaggattttttaaagaagctgatgatactaaactacaaaatggaacaattctttacagtataccctctggttctaaatagttagttttgctcttcccccacattgattgactatcattttggtagccacgggtctcagagttaacttttgttgccctagcttaattactctttttatttagttatatccgtataatttttcctttcattttaaagcaactcttaaatagttttctagctagaggaaaaatatattttcttttttaagcaaagtcaacatttttatgctttataaaattcaccaaaaacaaattttatgctcttgctattttaactttcagcaatccaaatttccagtgaaaaataacctaacctgagattttaacatgacttgaagcttttaaattactggagagttttgagatggaatttaccacattaattttaccaaagattcttaaggttatgaaaattaaaagggcatttgagatagcttgtaccagtctaacaagcagctacatttctttaagaaaagttacttgtctagagctctttcatgtagtttgggagttaaataccacttccacatgacacatataaagatagagatataacactcatgcggaataaaaaggcaggtccaaaggatatttcatttgactgtttttttaaaaaaattccctttcttactttagataattaataaaagttacaggagccaacaaaaggtgaaggagagagctatcatccatggccctttcaaagaggaagagctgaagttttgacctattttatctgaagaatttcaaagagacagattctagaatttaaaatttaataactttttgcattagtaataagttaatatttttaataaaaatcttgttttaaccaattatttcagttttacattagtgtatatttttaaatatcgaagatccatccctagaaagactattataattcctttttaatggtagccaactgaattatacaacccctttaaaaaaatatatttttactaatcctgttatgacttacatagaccactcaaaacatgtttagactttctgttttttcctaaatattcctctttcttgaatgacccagtcattttattctagggcaaaaatttactacacaagattctttctgatataaaattattttcctttatcccttctctataaaaaggtaccactttaaatttttttacatttctttttttctggttctttttatacataacatttaagtaggctgtcagttacacaaagatatttacattttaataagaacacttaaaaattttttataatttttaagttttgaattacctgtatactcaatatttatgaataaccttagatcctaaattatatgacaagtttgtttacgagcatttattccatcacattttcctgattacattattcaatagtttacctagattattgaccaaaactgtaacagtccttctgtaagttatttccctgttacccttttttatagctgtgcattttaggtgtttacttacataggaaacctaaagttaaatataagagtatttttacaaataatttaggatttcattaaaagaatattccatgtctttcttgtctaaaattacacaagcaaagatcattttgtcttggtctggctttcataattttataacccttatggttaatcttatattattctgcaggattaagcatggaattacttgatcaataaacacaaaacaaaaatgctaacaatttttacgacatttctaattttactttacccataattttaaagccagctcatttattaaatattttaagtcaagtgaccttaaaaagcatttgtgtagtcttttatttgattaagtatctgatttatgtgcttttatttttaaagccaattagagctcttgtatatatttttaatagtgaaacattgtgtacacaacacataaatacatagatgtattaggcatgccaatagatgtacatcttatagattcataagatcctattttttcctgtcttaggttttcaaattcttgataacctgtttgactaccttaggtagctgtcagctaaatagccttactctgcatatcaaaggaaacaattcataggtgaaaatcagataggaaacttacatctgaggaacacagcgaaatagtctgttgtgctagacagaaattaaaatggatgtaactgctacataacataaaattatagaaatcataaaagccttttaaatatatacatgcacatatttgcacagaaaagaaaatcctgtagcttttggttgagaactttaggaatgatatgaaactggcttgaaaaacgaacaaacagacaaacaaaaccctgttatatccaaacagtggcttttatctcagtcataatgtaacagctgatataaagcaggcagaaaagaaaagagagaaaaagagaccttaggaaatctataacttgcaggtcgaccttagggctttttttttttttttttttttttttaaatgtgcacaaagaccacgttacttccattttacataaagtctggctagtagagttgtcgtaaaatctaagaagtgcttgaaagtgggtcattctccttgttttctcctaagttttagatttttttctcaccttttttttaaggaggaattgagctgtggaatagagcttttgtggagtgggtcaaagggtgctgcttgtaggcaggactccagagtgtgtcaccactgtgtcactcctgccctcttacatgtctcaatttttctctccagaggtctaagcagctcctcaagttttttaagagaacaatacttgcaaatattgaaacaatatagcctgttcctgaaaaatgtaatatgttgtacaagatctagttttactgatgctgctctaacacttagaattccttctgcactctttggcatgtgggcagaaattccacccctttcttcgagtccctgccttcttcaagagttttttatttttgccgcacagcccatgtcccctaattctaacttccaacaaaaatatttgtctccatccatccctggagttgtcaaaacagggatcttcatgccgggtttctcaatgagccattacacagatttagcagggaaatgggagtaatatcaaagacaccttgtataaaccattggatgaccccagccctcgtctctgcccatgaacagctcccggggcagagagtcaggcagccctgctcttgtatccctcagaaaactcttgagattttgttcctaaagcctcccaaagagggaaaaggaattcatctcatgacatcccacttttcattcaagtgagtaattgcgttatgacacagagaaggacacagcattgctccccttactatagcctagcagataaagcaccagcaaactaaaacaccctaacttctcagtcaccatgcaagcccttttatatcaaatgcaatggacttttccacaagcaaaatgaatcttctgaccagcaggcatcctctgctttgactcgggcttggatacatattgtgcttcaacaaatctcagtactgaatctaaatatcaaggagaagtggtcccaggaaatatactgagaggactttgagcttttaccaaactgcacaatcccaaaatcatagactttactgaggccaattaaattggctaattcatgggtgaaagtgaaacatcataatgtttacaaatctgcccaactgtttttacgttaaagccagggtttatgtcaattcctgtgtgaggatgaggagacatcaattcaagcccatgacaatctggaaggacaggcagagactgtgtccaggcaggcctcacattgtttatactttgacctatttaattaaatatgtaatgttctccaaattttagatgtcatttgctgtaatcctgacccactaagatgtactatttgtgctgtaaaattgtattgtatttgacaaatgcatagtggcagatctctggcattaaagcatcacacagaatgtttctcttattcgagctcctctttcctccacatacagggaatcaacagactattttatacggtctttggactttgcttctttatttccaccctctttcataaaaaaaaaagaaaaagaaaaaagataccgtgctccatttgcatttgatcttccaaaaggaaggtactgataaaaccggaatttcagcgatacagacgcaggtcaaccgctaaacagtgaaggccaagagtcccgcgctgcaagcccatagccggcagagggcaatggaactcgctttctggtcgtgcggggcgcatgcgcattctgcttgcggaagcggggccagatcgccaaggaagaagggaacttcccttcctcaggccagggaggaggaggcgccgccctggctttggggcaaatggggctgcatccatcttaaggaaaacgctgctgttcacagccctacctgatgaggagtgagattccctgcgcgtctcccggatatttttctgaaacagcactaaagacttaatgttctgggctgttcctacgtgttttcttctgcactgtctgttgggatatattagcaagaattattttacaaatctacgtattccttagggattttcattgataaccatagcaggccgtaatgtgccttcctcgcaacctctgtcaggattcattatgaggagaaacacaagaagaattgtgaggaaaatctacagaatacggggaccctgcagaggaaggagtatgtggccggggcacggcggcgcactgtcgcgcagctcgcgagaaaggggcccctgcagggaaaccccgcactctgcatccctgcatttccacattgtgaggggctcatctttcctacagtgccaaattcactgaaaaatagtgagacaatgaaagggaggggcactaatgcatcctttaattgttgctattaaaacggcaagagccacgtctttaattttaccctagcactgcagatttaaaagtgattttcattacacatgcaaggggaaagctacacttttgtgaaaaatagtttctaccccaaatgaaaacatattgcttaaatatttcttcaaaaataagttattattctgtgctgcaggatatatcctgagacatttatgctgcaaatttattaatttatctattaaaacatttggtttataatcaaagcgattataaaggtagaatatgtatttggcacgtccctcatatttttattcttgtactggtttgcagtccataggttttcagctagacgtgacacacagaaactcaccatgaggagcctttctctttcttgactgtaaaatatacatactccagaatcatcaatagaggctatttcttgaatatctcaacctgaaccccgcagccagaaagaatgtaggcaattaatccaattttataactgcagctgatattcagctaattacctgctgttctcctcagaaattatcaaaatccccaaagcagagagttctctggataaaggcactaatgttccccttggaggcttttaagacattggcaaaattaaaggaatcttcctgttttccttttattcatctaaatgatttatctaactggagaagaaagcttcagtgcaaaaggcatctgctaattagattcaatttttttttaacatttaagggaaacagggtctatacttcacctaataaaactgatgaaattatcagctaaatgcaaagagaatccacaaacaaatttatacaagttctagagagaggatgaagccctgagctcaggggcctgttagagatggcacgctcagtaatggtgcaccctcacagattttccttctagttcagttctagtgattactggattactgttttcccccaataccatctattattctttatactgtcaaataatttttaatcttaaaatgactaattctgagttcaggcatatggtgtctggccacctgcaagaagtttaggtgactttgccaataagaatgatggatttgtaattaataagtaatgttgaaagcaaaacttgcattacaattctgaaattagtccagcggggatacaggcaagaaataaattaacagacagattaatacacaatgatatattagaaattaagtaaaggttctttttgtattttccccagcttgtcttatagtattcgcttcttctgtttggataactttccccaggagattcattttaaaacttaattcacttaaaataacgtatttttttttatttaaaaatactgtcagccctccacatccataggttccatattcatggatccaactaatcttgaatagaaaatattcacaaaagatttgcacaagtttcttcaaagaaactttaaattttccatgcatcacattctttttgagttcacataaatgacgtgacgtctgggcattgcattaagtattgtaagtaatctagagatcatttaaattatataaattaatgtgattatgttatattcaaattctacgccgttttatacaagggacttgagtatatacaaattgtggcatatttaaagtttcctagacccaatcctttatgtttactaagaaacgacgtacacatgaactttacagaaaataactgtcctaccaaattaatgaacagactacaatagaaagtaaatattgctagtttaaaatactgttattttatgtcacaattatatggtgaatcagagtagagatcttgaattaattttgattgaattaggctaattctgactgggtcacactcatattgactgagttttgataaaaccactcccatgctggcccttcatgttgtttaatcagcaccactagccaatcacattcatccattttgacaaatcccatggctccacctcttataagacccttggaggatttccccaagagctcactctaccaaagcaccatttgaccggtcccaggccaggacacactcttccatgctctggctgtgctgtgctagaggctgataatttttctccaggtagagtaaaagatcaaggcacgaactatatagatttacagaaaataggccaaagattgagatttttttgacacaagcaagtccagagaacttttaccatgtatggttaccggcgcttaagaagccccagagattcccagacagaaccgcagaatgacaatgaaggagagaccaggtatgttggagtatgtggctactttgggttgccaggaggttgacatgtgactgtgtgtgactgtatgtgtgtgtgtgtgtgtgaatgtatgctaaagggccaaactagggcagagaagacaccctggcctgccatgacattgaatgttataaatttagaacacattggggagacatgagacccacagtggaggccacaggatgcagccagcatggggggtttctgcagcctgtcagggggctcatctcatgtttcttcccattgttaatctctgtcctctgggtaaacagaagttgcctcttgtgtggagacaggtaaactgtgggcatgatctaaattttttccttgtgctcactagaaaatggaacatttcatgtcatttatcactccattcacactgtaactgcatagacacaggggttagatacccggaaaatcagcatcttctcctaaagtcctcgggccaaatttgatgtccctccttctcatgtggatgagctcctgaaaaagcaaactgtttcctgtgatcgccatgtcttatcacacacatgcaccgataggaaaagcctctagaaaaggagagggtgggatatgagtgttaggactttctggatgcaggtaggatttggagctgaacacaagtgcatgtgattttgggccacagcagcaatgtgtgccggatgactaatgaagtttggggcttgtgagaattggactttgtgtcactatgtggaagattgatgggtccctttctgtcctgcagtttggctaccacacaaatgaatccacccaaacgtcgccaagtggagcagggtcccagtacaggtaaggcactttccctaatattttttaagattcccatgcctggaagtcagtgtcatgtctcatgataccataaatggagagggtgctttctgcagggtgagtggaaagtcgtgcttgactgttgggggctggtgtcctgaggctggccagtgctgggtggtggatttctgaaggtcacattctgaaatgcaagagactcttgctggaagagagccttaacctccctcactgtggtctctctgcaggtgcaaaaaaaccctcaatttcaggagctccacacctgaattcataccagtccctggaacttccccaggtaagttcctgtgtccttgcatagcaaagattggatagtgctgcacaatcttcaggttcaagggacatccagtggatgtatatttaggtggattggcatgagcaccaattctgggagggagtttgtattttaaagttgtaaagggtgaagctcctggcatctccctccccatgagcatcatttgcagcctttttggagggcagaatactgaggactgtctttccacagaatcagcaggattctggcactgaggagctcatgatagtcctggaacaagggacagaagtgaggttgagcctggaagaggtcatcctcatcttggccccagagacagtgctgcagctgaccctggagaacacagtccttgtgattgtccctgagcatgtcctgaggtcagaagatggcctgcagtcccctgtgcagatccagtacatcataccttccgttgatgacttcagcttggagttccatgctcaagatggagacatctcagacatgagaagagagaatgtgcctttttcacctgcagaagaagggaaggcagcacccctgtatcagcagcccttgatgataccccaagcaaaccacatggctgggatcagcccttctttcctagtaaccccattgtgcattccacgctgtcgggcagccttcccccaatgctaccctctaccacccacacctagtcctgtgggacgccctagaccagccgactccagtttcagcctgcatggtatggagctcttgtgcacctcctccctcagacctatgcccccttcaccaagtcctggtccccaggtctatcacagggttcaccataggcctcccagcagggcacggagatgtctctttaggaagtgatttaacccaagagccaccccctgcattgataggtcagagattgtccagatccttagtcagtgcattctctgaaatgtggagagaaagtaatttgaccacttgcttgccctttgctgttccccatcatcaaccactgtcttcaacagcggagggtcccagatgctgcagggagggggagaactgcagggagttcaaataaaacattcacatttcacttcacacacactgtcccttagactttctcttcctatttaagcacatacatccaaccacactcaatcaaatccctgactgctccatgtgagagttctgcttccagcatgacgtggtctgaaagttcatctgaagacagctgctcactcccgggggctaacaccgccccttgcatgctgatgtccttgtagtcattggtctgatgccacaataaataattcctaaggctgatgctctatttctgccctgagactctcccctttttctccaagctgtgccccattccttgtcttagtccaggttccctacactccccaggccaatgcttttgaataaatcttgacgtcattgaatgaagtagtggtgactgctgtgcttgcttccaactgagacactctcctgctctcactcatcacgtttccattcacatttgcctttgtttagttttgttttccattgtttgggtttattattcatgtacttatgaaataactgccacatttctgacagtttttttggccaatttggggcttttcctgtgctcctccttccaagtcctgagtggggtcactgtttgcacctctgggccctgggatgggtctggcttagcaaatggttgaacagagcttagctctgtgtgttgggacgggcacctgcacttgctcacagctgcttccaggctctccctgtcctgcctggacgtctctgtgtctctggagtgtctaggaagtctagaagttctcttgagggcccagcacctctttgttggcctgcatgtcccagcctgtatgtccatggccagctagagctaccactagcttttcctggccaacctgggagctcaggcctgagtcctggaggcaggggagatgcagggataatgtcctggccttctggagcccaactccagtaggtggggagtgctcatgaccctgcggggagtacagggcgtttgcccttgacttgcctgagcctctaaaacctcacatgtcccctggaggtgggtgcagcttcctcctactctggccttgctggcctgggaagggcgtccttggtcccttgaaccctcacagcattttctcttctactgaggtttcaggaactgcctttcccctctgggaaggaggacagggactctttcaggtttgattctcctcggggttttagacgttggctgaggtgggaactgccttcatccacatgaaaggcccagccagggcatcctcaccagcctgggcctctgggtaggttctgagtctggtcgctggagaggccgcttctgtgagccccaagacagcagcccctgtgaaggccattctcctctgttccctcagggtgtcaggacccgcctgtgtccaggaagtcccctctgagactagattgtccttggtgcagccctcccagagccgtgcagaggcagatgtggtgcactgggcctgggctctgaggaagcagtggtagcgggggccagggaggacccaggctctagggcaagggagtgtctaacctgggtagagctgggccgcattcagggagtggcactccagggttctgtttcaggtggagcaggggccaactcaggatcaagtacctctccttccacctccaggactcacccaggggcaggcgggagctccaggttcttctcctcctcctcctcctcctcctccatgtgttttctcttgctttatttctctgagtcaagaaattggggctgtccttcatatcggtgaattttgaccctaatcatcatgaccttgttgaggaaaagagtcatactctgcaaaatatttggagatatttattctgagccaaatatgattgaccatgtcgtgtgacccagccctcaggaggttctgagaacgtgtgtccaaggtgatcagggtgcagcttggttttatgcattttagggagacatgacttcaactaagtgcatttaagaaatacgttgatttgatccagaaaagtgggacaacttgaaggaggggggcttccagcttatagatagatttaaaaattatctggttgataattggatgagtttatctaagaccagggatctattgaaaggaaatgtttaggttaagataaagaggtggggaggccaagttttactgtgcagaggaaccttcagatagtagacttgagagggagtaggttgtaaaatgtttcttattggatttaaaagggagcctggtctttgttgattatctcctgtgtctggaaagaaagaaagaagaaaaaaaggtggggagccttaacctccctcactgtggtctcaccacagatgcagaaacacccttacttcaaagaattcctcacatgaattcattccaggcctggaatcaccccaggtaactccctatgttcatggatagcaaagattggactatgttgcataatctccaggccacaagacacatccagtggtggtgcattcagcagggtcagcatgactgccacttctaggaggaaatttgtattttaaagttgtagagggtgaagctgctccagctccctccccaggagcatcatttgcagtcttttttgaaggcagtggactgagggctgtcgttccacagcagcagcagaattccagcacagagacgttcatcatcgtggtcccggaacaagggacagaactcacactgagactggaagagtatgtcctcatcctgtccccacagacagccctgccctgaccctgggtaacagcgtatttgtggttgtgcctgagcatgtcctgaggtcactggatggcctgcagttccctctgcagatcgattacatctagcactctgtggatgacttcaccttggagttccatgttcaagacagagacacctcagacatgaaagagacaatgtgccgcgctcacctacagaagagggggaggcagaacccgtatgtcaccagcccttgatgagatccgaagaaaaccatgttgcttggctcagcgcttctctttcaataatcctactgcgcattgcatactttctcctctgtgccctaccctttaccaaccacacctagtccagtgggattccctagaccagccaatctcagcttcagcctgtataggatggagactttgcccaactcctccctcagacctatgcacccttcaccaagtccagcactcaggtctgccacagggttcaccatagttctccaaccagagcacgaagatgtgttttcaagaagggatgtagccaagatccaccacttacattgatagatcagagattggccaaatccttagtcagtgcatgccctaaaatgtggagggagagtagttccaggaacctcttgcttccccttctctgtttcccatcatgatccattgtgctcactagcagaggatcccagatgctgcagggagacgaagaactgcaaggtgtgtaaataaagtgctcccatttcacttggcacacagtgtcccttagaatttctcttccatattcaacctcttaaatgcaaccacactcaatcaaatcccttactcctcaacgtgagggttctgctttcagcatgctttcagtggcgtgaaaattcacctgaagaactctgctcactcccagggctaacacagccccttgattgctggtgtccatgtagtcattggtctgatgtatagataataattcctaagcttgacactgtatgtatgccctgagattttcaccattttctccgtgctgtgacccagtccttgtctttgttcaggttccccacactccccaggccaatgcttttcaataaatactgaaattataggatgaaatagtggtgactgctgtgattgcttccaagtgagacacgcttctgctctggctcatcaagtttacattaccacttgccattcctaagttttgttttcaatttttggtttgtatttcatatacctgtacactaaatttcatgatttgggcagcattttttttataaaggcagggccataactttgaggaggacagacaagtttctatctccttcgtgtagaaaaaaaaaggcaatcacaatgctgatttcaaacattttggataaaacagtaaccaggcatgtccggtgtgtagagtgagatgctactgtgttttgaaacacaatggaaaggctcttgattaatgtatcttatgaggagaggcctaaatataaatttaaaaaatagttacagtagtgtatcactgcataagtatctaaaaaaagaacgacaactggataacacaagtgagggtctatgttccctgaaccggaagagacaggcaggagtcggaatgatgaaccagcacactggggcgttttctcatgtagcccaagtgaccccatggtcttctcgagctttggaaccagtcgcgtcccctttgacactgcacccggctcccagtctctcaatcttgttggccctccggcgatctcccgttggatgaattgctcctgctgaaactcgagtcccctttgatttgcgcttcattaattattcatgattcaggttcgaaggcctgctgacgaccccctgtggccgttctctgagctttcctgtcacatcgtttccttccacactctttggttccttatggtcctgctccttctgctgtcagaggagcagagagttgatcttattcattctggatacggatactttctaggtgatctggataatcaagataacgaccctcaacagcggcggaaagggagcagccagttggtgtgtctcagaaaatcccactgagttccgaggcctcctagatgtggaatcctgctgagagttgttcccaggtcagagaatggagagagcctgtgcatgatgggatatccccgcctagatctttcagtgagtctctacctcagcaactcttaggatcagggggagaaccatggtgtcagacatccggaaagaagacgggatgaatgttttacctctgaagtacatcccaaatgtgggagttaacttcagctttgctggggtctatttggccagtgaaacgctgcctggttccttcgcacatccggaagccacttcacggggggccgtcgcaactggaaccacacacttggcatcggcggttgagccaaatggggactcgtggtgcaagcaacgctccccacgtgttagcgtgcgtgagattcggttggcggaattttactaggtgcgtgttggtagagtggggctgaggttttcttgctcctgtggatgtataggaagtcaaaggtcctgcccagccctgcggtcccctcagtcaactctgtttcggagacgtaacgatttggattgccaacaagtcaagatatgttcaagcccttggatgtagggtaaagaaagagagatcagactgccactgtgtctatgtagaaggggaagacacaagagactccattttggaaaagacctgtagtttaaacaattgctttgctgagatgttgatcatttgtagctttgccgcagccccttcctttgacccaacttggagctcaccaaaacctgtgctgtataaaatcgaggtttaagggatctagggctgtgcaggacgcgccttgttaaccaaatgtttacgagcagtatacttggtagaagtcattgccattctctagtctcaataaaccaggggtgcaatgcaccgtggaaagccacagggacctctgcccttgaaagcagggtattgtccaaggtttctccccatgtgtcagtctgaaatatggcctcgtgggatgggaaagacctgactgtcccccagcctgacacccgcaatgggtctgtgctgaggtggattagtcaaagaggaaagcctcttgcagttcagatggaggaaggccactgtctcctgcttgcccctgggaactgaatgtctccgtgtaaagcccgatcgtacatttgttcaactctgagctcggcgaaaagctgccctgtggcgggaggcgagacatgctggcagtaatgctgccttgttattctttactccgctgagatatttgtgtggagagaaacataaatctggcctacgtgcacgtccaggcatagtaccttcccttgaacttaataatgatatggattcttttgctcacgtggttttttttttttttgtttttttttttttgttgaccttccccttattatcaccctgctcccctactacattcctttgtgctgaaataatgaaaatcataatcaataaaaactgagggaactcagaggccggtgccggtgcaggtccttggtgtgctgagtgccggtcccctggacccactgttgtctccctatactttgtctctgtgtctgatttcttttctccgtctctcatcccacccgactagaaacacccacaggtgtggaggggcaggccaccccttcacttggaaaatcagttacacacaaacacggaatgagagtcaaaagacaatatgtcatctttttgagaattttattcacttcaaaaccaattaaacacacatatgtacaaaggcattccagagcccagttttcgaggctgaggaaagaccccgagagcgctttgcacagcacgcttcccagcgtccgaaacactgttctcagggcggggcacagcggaagggctgcacctctcagcgttccctaacttttcccttattcagtcatctagagagcaaatacacagtaattccccagtttcttattgacgtcccagcggaagtctgactcctgcgcgtcacgcagtttctgaggcaacgaatctctggcggaagcttttcctggcgcgtttcgggagaaccacgccaactacaacgtccctcaccagaattcaatgaggcagagtccctgcatctgctccctgcctggcctgggctcccacatccacagaagcgccacagccggggagcttcggagtcaccgcacagagtgtgctctctgctctgcgctcctcagtcccacagtcccctccaagtcacgggagctggaggccaaggagcccctgccacctgcagtctcactccaggtcagaatcgctgtcctctgaggaggaggaaacctgaaggtcctcatagaggacgctcggtgggacacgaacacagggagcctcagacttctctgacacatgagggctctgagcgaggaaggctcccggcttctcaggagagtgaaatgagggggcggccaggaggctggagctccagcgtccgttttccagtctccggaagagcactctgagaggctgggccccatcatggccggccgctgggtgatgggacatggtgcaggcctgggcagtaggcaggcaaggtgtgctgtgcggaggctgccggtcgacgctgggcacctgggccggtgtcctcctgcccatctggggcgacgtacttggtccaagttcggttgcggctggcggaggttggagattctccggggcccgcagctcacctccctggatggcgctttcggggatctggaagggacccagtctcggttcttgggaagttcaggcaagcctgaatcggagcctgggcaggtctcttggctcctggcccgaagctgagattggagcctaggcccaagctgtgtgtggcggctggcgggcagggctgtgaggtcaccgcaggacgtttgtcttgtgcctggggtctgacggcctggagcaggccgtgggttttggaggcagcctggggaacttctcggcagccaccctcaggggctgctgtgtgtcggcttcaccacgaggagaggctcggggccctggtgcctgaatgcaggctgagggatgtcggccgcagcccctgtctgtctttcctttggtccaagacttgaggaggagctcaggctggcttttctgaggggagacagtgaagccaagacggagcccctgccagacatttcggtagctgagcgatcagcgaggacagggtccacgcgcggcctcttactggttgtgtggaccggcattggcccgcttgcaacctgaaagagaggaaacaacacaggttagaagttccacggcatggagccaacgtgaaaatcaaacatatccaaagacaaggtgcacacgccatgaaattcttagtacagtatcgacaggcggtccttggaagtagggacagatccctccacctgagtgctgatcaggacaagacacatgaaaggtgcgctctcgagctatgtgtagctgatctaagcacaccattgttcaaaagatcgcgtcttgggcattaactggatcaaagcgcctccactcagccttccatgaagtggaacggactaatgcccttcccgaggcaggttggtggctcaagggtactcgggacgtcttctctgaacacatgcatgttcctgggtttagccttctccacgtttggggcctctgagggactaatttcctcatgccgctaggaacgtgttgttggcaggcttgccataattggacagaaagaaagccacaggaaatacggcatcttcagatgccttcgcctggaatccaattgacctggaaggattgtggagtccctgaccccaagaaggcaagaaagaggggttccccgatttcctcccgcagacgggaagctgaaaggaaatcaaccagggtgacctagaggagaaaaggaccaggggcccggggtgacactcaccctcagatgctcggaagattccgtggatccttttccattcggcagcggcttctctggaggtttcccggaaaacatgtggaggagagcgttcctctgcgggtcttgttgcctgcagaacagaaaaaggtcaggcggtgccccctggttttccccaggagacagggagaaccccgtctggggcccagccccattccgtgttttgtgatacagaaatggacatctggtgccctttccgcctctgcaccttccctcacgtgccaaccttcccatcctccaggtggccctctaggcttcccgactaaggactgtgatttggattccatcgcttttcccgctgtcgtggggaacctgcacgaagcgcccccgcctctccccgtccctgaatctcccagagcccaaggagctcctgggtgtggaaccccggaggacacggagctccggcctatttctctgcagcgctccttccctggcccggagacggaaaggcacacggtgtgcaggtgcagagacaccatctccttagaggcagcaccctaagagtggtgaaaacccctcccactgctcaccttggtctctcttccttctctcccttatccttgttcaagggccccgggttggcttcagcccggggcttccatggtttcaggttttccttcccttcctttttccccaaggtcgctggaaccagggctgccttccagcacttcatggggcacctggtacttctggccgtgtggccaaaggccccgcagtttttgcacttgagctgtgggtggaaaggaagtgatgtcagtgagtgagctgaagccacaggcagcgatcccacgtcaacattgggacggattgtgaattcagagctgaataaggattccgaagaggggacaccggcatgggggccgttaagtgctgggagagttcggatacgatgttccctcgcaaagcccttgtgacggagtaactctgaaaggaaggactcaaggttccaaggggcacgatggtgaagccgatgtcaacaacgcagccaaacgtggctacacaggactcgaagtagaaagggaggttgcccccaagagtctctcaagggacctatcgggccggggagaaggtcccaagccacgcccaccttggatgggaaaagcaacctggctggtggtgacagaactctttggaatccaacccagtctctgaggaccgtgggacaccgcctccccccgtccccacccccaccccgatacccaagagatccagggctagacttaccctgggatcttcttcatcgggcgggggagaccttggcccaactggggccctccgctgcttctggagggtctgggctctcaccagtctcttggcccaagatttggggtcccgacgtgccatcatcttcgtctcctgggggttttatgaccgcctttttcaggggtggactgttgggccacctgaaacacacacaaacacacacatgtcgatggttaagcacgttggatattcacacacccacaggaagccacctgctaactccctgcctgtgtggtcatgaggagacctcaccaccagtcggtcaaatctgtagaacacaatgtgctgtgcgcatcctcggatattgtgtgttcctctgccatgactacctagtccaagagtaaaccccacctgccacagggcccgtggcctaggtatggggggttgagctttcaaccccaaacaaacaactgattctggagactggacttaggtctctcacgattcactccggtagaagacacggtgattctatctcccttgacggacagaatgatcgaagacacagggcatggcgtgtgccaccctttggcaggtctgcttgaagtcacggataagggatgcttcctgtgataacttgaatcgctactcttgccatttcattaggcaacttccaaacacaaattcatacagagaagttaccttcctctctaccgcactagcaggtgatggtctttcctgttctatcttttggctttagctccagcccctctttatttattttcctggtattttacgcacaccacacgaattcatctgaacaaacggggaagaagtgccgtatcgtatcgacgtcttacacggctgaagggcaaaccccccttttttccaaagtcctttttccatttacccaccaattcagcatgctgcagtacatttcttttcgcattcccatcttggtcttctcccacacgtggagacggatatgttgtctcgttttctgttccaagaattactagtaacgagaacacatcctaccccaccagcaagccccagtgtgatcggtttctttcggcctcctttgtctcttcctccccccgccccccccccgccaaaaccactcagggattgcgtgaaacaaacaattgttcagcgaaactaacctgaaattacacgtctactttctttcccaggctggcgctgagatgggcaggtgctgcagcagcccggctggaagcgatgcagcatccaggacgacggaggaaggggcagagagggacctccgctttccaggctgccttttatactgcctctggtcacctgacatggaacgtaccctaacctaatcagttacctgtaccttaattgcaattaacttaatccaattacatgacctggaaaggtctatctgcacagcccactctaagatcctgtccactgctgacagacattctaaaacctacttgtacagctgcaagctttgaacaatagatgttccccgtcagacatgtaacactggtgcctgtacccgtcttcttttccatcttttttgtcgtttagttttgttttgttttaaaaaatgtggtaaaatagacaccttttaattggaccacattttgtctatctcgacgtaggcctcagtgtcatcaaggagactctccttgacgtgcagtcacggccatgatccatcttcagagcttctctttcttccccaaggtaagtctgtcagcagagaaccctgaccgcaccctcatgtgttttctcccccaggaggcgcttggaaaccaccgtgaattggaccgcactgggaaacacagatgaggaaagtcaacaacgctttgtccttcagtgcctggctcctttttcagctcctcttgcgactccaggcattatgcctgaaaagtctcccggacgcctgtgaggctctaattccctgggtcccattgccatgtctctggatttgcgaagatccaccgcaccttctgtggaactcccgtgtcggtgaactttagtgccacggcccctaattctgcccatggtcatccgcacctgcacgacttagggtccatgttccttggacgggaagagacaggcaggagtcggaatgatgaaccagcacactggggcattttctcatgtagcccaagtgaccccatggtcttctcgagctttggaaccagtcgcgtcccctttgacactgcacccggctcccagtctctcaatcttgttggccctccggcgatctcccgttggatgaattgctcctgctgaaactcgagtcccctttgatttgcgcttcattaattattcatgattcaggttggaaggcctgctgacgaccccctgtggccgttctctgagctttcctgtcacatcgtttccttccacgctctttggttccttatggtcctgctccttctgctgtcagaggagcagagagttgatcttattcattctggatacggatactttctagttgatctggataatcaagataacgacccacaacagcggcggagagggagcagccagttggtgtgtctcagaaaatcccactgagttccgaggcctcctagatgtggaatcctgctgagagttgttcccaggtcagagaatggagagagcctgtgcatgatgggatatccccgcctagatctttcagtgagtctctgcctcagctactcttaggatcagggggagaaccatggtgtcagacatccagaaagaagacgggatgaatgttttacctctgaggtacatcccaaatgtgggagttaacttcagctttgctggggtctatttggccagtgaaacgctgcctggttcattcgcacatccggaagccacttcacggggggccgtcgcaactggaaccacacacttggcatcggcggttgagccaaatggggactcgtggtgcaagcaacgctccccacgtgttagcgtgcgtgagatgcggttggcggaattttactaggtgcgtgttggtagagtggggctgaggttttcttgctcctgtggatgtataggaagtcaaaggtcctgcccagccctgcggtcccctcagtcaactctgtttcggagacgtaacgatttggattgccaacaagtcaagaaatgttcaagcccttggatgtagggtaaagaaagagagatcagactgtcactgtgtctatgtagaaggggaagacataagagactccattttgaaaaagacctgtagtttaaacaattgctttgctgagatgttgatcatttgtagctttgccgcagccccttcctttgacccaacttggagctcacaaaaacctgtgttgtataaaatcgaggtttaagggatctagggctgtgcaggacgcgccttgttaaccaaatgtttacgagcagtatccttggtaggagtcattgccattccctagtctcaataaaccaggggcgcaatgcaccgtggaaagccacagggacctctgcccttgaaagcagggtattgtccaaggtttctccccatgtgacagtctgaaatatggcctcgtgggatgggaaagtcctgaatgtcccccagcctgacacccgcaatgggtctgtgctgaggtggattagtcaaagaggaacgcctcttgcaattcagatggaggaaggccactgtctcctgcttgcccctgggaactgaatgtctcggtgtaaagcccgatcgtacatttgttcaactctgagctcggcgaaaagctgccctgtggcgggaggcgagacatgctggcagtaatgctgccttgttattctttactccgctgagatatttgtgtggagagaaacataaatctggcctacgtgcacgtccaggcatagtaccttcccttgaacttaataatgatatggattcttttgctcacgtgtttgttttttgttgttgttgttgaccttccccttattatcaccctgctcccctactgcattcctttgtgctgaaataatgaaaatcataatcaataaaaactgagggaactcagaggccggtgccggtgcaggtcctaggtgtgctgagtgcctgtcccctggacccactgttgtctccctatactttgtctctgtgtctgatttcttttctccgtctctcatcccacccgactagaaacacccacaggtgtggaggggcgggccaccccttcacttggaaaatcagttacacacaaacacggaatgagagtcaaaagacaatatgtcatctttttgagaattttattcacttcaaaacacattaaacacacatatgtacaaaggcattccagagcccagttttcgaggctgaggaaagaccccgagagcgcttcgcacagcacgcttcccagcgtccgaaacactgctctcagggcggggcacagcggaagggctgcacctctcagggttccctaacttttcccttattcagtcatctagacagcaaatacacagtaattccccagtttcctattgacgtcccagcggaagtctgactcctgcgcgtcacgcagtttctgaggcaacgaatctctggcacggaagcttttcctggcgcgtttcgggagaaccacgccaactacaacgtccctcaccagaattcaatgaggcagagtccctgcatctgctccctgcctggcctgggctcccacatccacagaagcgccacagccggggagcttcggagtcaccgcacagagtgtgctctctgctctgcgctcctcagtcccacagtcccctccaagtcacgggagctggaggccaaggagcccctgccacctgcagtctcactccaggtcagaatcgctgtcctctgaggaggaggaaacctgaaggtcctcatagaggacgctcggtgggacacgaacacagggagcctcagacttctctgacacatgagggctctgagcgaggaaggctcccggcttctcaggagagtgaaatgagggggcggccaggaggctggagctccagcgtccgttttccagtctccggaagagcactctgagaggctgggccccatcatggccggccgctgggtgatgggacatggtgcaggcctgggcagtaggcaggcaaggtgtgctgtgcggaggctgccggtcgacgctgggcacctgggccggtgtcctcctgcccatctggggcgacgtacttggtccaagttcggttgcggctggcggaggttggagattctccggggcccgcagctcacctccctggatggcgctttcggggatctggaagggacccagtctcggtttcttggggaagttcaggcaagcctgaatcggagcctgggcaggtctcttggctcctggcccgaagctgagattggagcctaggcccaagctgtgtgtggcggctggcgggcagggctgtgaggtcaccgcaggacgtttgtcttgtgcctggggtctgacggcctggagcaggccgtgggttttggaggcagcctggggaacttctcggcagccaccctcagggctgctgtgtgtcggcttcaccacgaggagaggctcggggccctggtgcctgaatgcaggctgagggatgtcggccgcagcccctgtctgtctttcctttggtccaagacttgaggaggagctcaggctggcttttctgaggggagacagtgaagccaagacggagcccctgccagacatttcggtagctgagcgatcagcgaggacagggtccacgcgcggcctcttactggttgtgtggaccggcattggcccgcttgcaacctgaaagagaggaaacaacacaggttagaagttccacggcatggagccaacgtgaaaatcaaacatatccaaagacaaggtgcacacgccatgaaattcttagtacagtatcgacaggcggtccttggaagtagggacagatccctccacctgagtgctgatcaggacaagacacatgaaaggtgcgctctcgagctatgtgtagctgatctaagcacaccattgttcaaaagatcgcgtcttgggcattaactggatcaaagcgcctccactcagccttccatgaagtggaacggactaatgcccttcccgaggcaggttggtggctcaagggtactcgggacgtcttctctgaacacatgcatgttcctgggtttagccttctccacgtttggggcctctgagggactaatttcctcatgccgctaggaacgtgttgttggcaggcttgccataattggacagaaagaaagccacaggaaatacggcatcttcagatgccttcgcctggaatccaattgacctggaaggattgtggagtccctgaccccaagaaggcaagaaagaggggttccccgatttcctcccgcagacgggaagctgaaaggaaatcaaccagggtgacctagaggagaaaaggaccaggggcccggggtgacactcaccctcagatgctcggaagattccgtggatccttttccattcggcagcggcttctctggaggtttcccggaaaacatgtggaggagagcgttcctctgcgggtcttgttgcctgcagaacagaaaaaggtcaggcggtgccccctggttttccccaggagacagggagaaccccgtctggggcccagccccattccgtgttttgtgatacagaaatggacatctggtgccctttccgcctctgcaccttccctcacgtgccaaccttcccatcctccaggtggccctctaggcttcccgactaaggactgtgatttggattccatcgcttttcccgctgtcgtggggaacctgcacgaagcgcccccgcctctccccgtccctgaatctcccagagcccaaggagctcctgggtgtggaaccccggaggacacggagctccggcctatttctctgcagcgctccttccctggcccggagacggaaaggcacacggtgtgcaggtgcagagacaccatctccttaggaggcagcaccctaagagtggtgaaaacccctcccactgctcaccttggtctctcttccttctctcccttatccttgttcaagggccccgggttggcttcagcccggggcttccatggtttcaggttttccttcccttcctttttccccaaggtcgctggaaccagggctgccttccagcacttcatggggcacctggtacttctggccgtgtggccaaaggccccgcagtttttgcacttgagctgtgggtggaaaggaagtgatgtcagtgagtgagctgaagccacaggcagcgatcccacgtcaacattgggacggattgtgaattcagagctgaataaggattccgaagaggggacaccggcatgggggccgttaagtgctgggagagttcggatacgatgttccctcgcaaagcccttgtgacggagtaactctgaaaggaaggactcaaggttccaaggggcacgatggtgaagccgatgtcaacaacgcagccaaacgtggctacacaggactcgaagtagaaagggaggttgcccccaagagtctctcaagggacctatcgggccggggagaaggtcccaagccacgcccaccttggatgggaaaagcaacctggctggtggtgacagaactctttggaatccaacccagtctctgaggaccgtgggacaccgcctccccccgttccccacccccaccccgatacccaagagatccagggctagacttaccctgggatcttcttcatcgggcgggggagaccttggcccaactggggccctccgctgcttctggagggtctgggctctcaccagtctcttggcccaagatttggggtcccgacgtgccatcatcttcgtctcctgggggttttatgaccgcctttttcaggggtggactgttgggccacctgaaacacacacaaacacacacatgtcgatggttaagcacgttggatattcacacacccacaggaagccacctgctaactccctgcctgtgtggtcatgaggagacctcaccaccagtcggtcaaatctgtagaacacaatgtgctgtgcgcatcctcggatattgtgtgttcctctgccatgactacctagtccaagagtaaaccccacctgccacagggcccgtggcctaggtatggggggttgagctttcaaccccaaacaaacaactgattctggagactggacttaggtctctcacgattcactccggtagaagacacggtgattctatctcccttgacggacagaatgatcgaagacacagggcatggcgtgtgccaccctttggcaggtctgcttgaagtcacggataagggatgcttcctgtgataacttgaatcgctactcttgccatttcattaggcaacttccaaacacaaattcatacagagaagttaccttcctctctaccgcactagcaggtgatggtctttcctgttctatcttttggctttagctccagcccctctttatttattttcctggtattttacgcacaccacacgaattcatctgaacaaacggggaagaagtgccgtatcgtatcgacgtcttacacggctgaagggcaaaccccccttttttccaaagtcctttttccatttacccaccaattcagcatgctgcagtacatttcttttcgcattcccatcttggtcttctcccacacgtggagacggatatgttgtctcgttttctgttccaagaattactagtaacgagaacacatcctaccccaccagcaagccccagtgtgatcggtttctttcggcctcctttgtctcttcctccccccgccccccccccgccaaaaccactcagggattgcgtgaaacaaacaattgttcagcgaaactaacctgaaattacacgtctactttctttcccaggctggcgctgagatgggcaggtgctgcagcagcccggctggaagcgatgcagcatccaggacgacggaggaaggggcagagagggacctccgctttccaggctgccttttatactgcctctggtcacctgacatggaacgtaccctaacctaatcagttacctgtaccttaattgcaattaacttaatccaattacatgacctggaaaggtctatctgcacagcccactctaagatcctgtccactgctgacagacattctaaaacctacttgtacagctgcaagctttgaacaatagatgttccccgtcagacatgtaacactggtgcctgtacccgtcttcttttccatcttttttgtcgtttagttttgttttgttttaaaaaatgtggtaaaatagacaccttttaattggaccacattttgtctatctcgacgtaggcctcagtgtcatcaaggagactctccttgacgtgcagtcacggccatgatccatcttcagagcttctctttcttccccaaggtaagtctgtcagcagagaaccctgaccgcaccctcatgtgttttctcccccaggaggcgcttggaaaccaccgtgaattggaccgcactgggaaacacagatgaggaaagtcaacaacgctttgtccttcagtgcctggctcctttttcagctcctcttgcgactccaggcattatgcctgaaaagtctcccggacgcctgtgaggctctaattccctgggtcccattgccatgtctctggatttgcgaagatccaccgcaccttctgtggaactcccgtgtcggtgaactttagtgccacggcccctaattctgcccatggtcatccgcacctgcacgacttagggtccatgttccttggacgggaagagacaggcaggagtcggaatgatgaaccagcacactggggcattttctcatgtagcccaagtgaccccatggtcttctcgagctttggaaccagtcgcgtcccctttgacactgcacccggctcccagtctctcaatcttgttggccctccggcgatctcccgttggatgaattgctcctgctgaaactcgagtcccctttgatttgcgcttcattaattattcatgattcaggttggaaggcctgctgacgaccccctgtggccgttctctgagctttcctgtcacatcgtttccttccacgctctttggttccttatggtcctgctccttctgctgtcagaggagcagagagttgatcttattcattctggatacggatactttctagttgatctggataatcaagataacgacccacaacagcggcggagagggagcagccagttggtgtgtctcagaaaatcccactgagttccgaggcctcctagatgtggaatcctgctgagagttgttcccaggtcagagaatggagagagcctgtgcatgatgggatatccccgcctagatctttcagtgagtctctgcctcagctactcttaggatcagggggagaaccatggtgtcagacatccagaaagaagacgggatgaatgttttacctctgaggtacatcccaaatgtgggagttaacttcagctttgctggggtctatttggccagtgaaacgctgcctggttcattcgcacatccggaagccacttcacggggggccgtcgcaactggaaccacacacttggcatcggcggttgagccaaatggggactcgtggtgcaagcaacgctccccacgtgttagcgtgcgtgagatgcggttggcggaattttactaggtgcgtgttggtagagtggggctgaggttttcttgctcctgtggatgtataggaagtcaaaggtcctgcccagccctgcggtcccctcagtcaactctgtttcggagacgtaacgatttggattgccaacaagtcaagaaatgttcaagcccttggatgtagggtaaagaaagagagatcagactgtcactgtgtctatgtagaaggggaagacataagagactccattttgaaaaagacctgtagtttaaacaattgctttgctgagatgttgatcatttgtagctttgccgcagccccttcctttgacccaacttggagctcacaaaaacctgtgttgtataaaatcgaggtttaagggatctagggctgtgcaggacgcgccttgttaaccaaatgtttacgagcagtatccttggtaggagtcattgccattccctagtctcaataaaccaggggcgcaatgcaccgtggaaagccacagggacctctgcccttgaaagcagggtattgtccaaggtttctccccatgtgacagtctgaaatatggcctcgtgggatgggaaagtcctgaatgtcccccagcctgacacccgcaatgggtctgtgctgaggtggattagtcaaagaggaacgcctcttgcaattcagatggaggaaggccactgtctcctgcttgcccctgggaactgaatgtctcggtgtaaagcccgatcgtacatttgttcaactctgagctcggcgaaaagctgccctgtggcgggaggcgagacatgctggcagtaatgctgccttgttattctttactccgctgagatatttgtgtggagagaaacataaatctggcctacgtgcacgtccaggcatagtaccttcccttgaacttaataatgatatggattcttttgctcacgtgtttgttttttgttgttgttgttgaccttccccttattatcaccctgctcccctactgcattcctttgtgctgaaataatgaaaatcataatcaataaaaactgagggaactcagaggccggtgccggtgcaggtcctaggtgtgctgagtgcctgtcccctggacccactgttgtctccctatactttgtctctgtgtctgatttcttttctccgtctctcatcccacccgactagaaacacccacaggtgtggaggggcgggccaccccttcacttggaaaatcagttacacacaaacacggaatgagagtcaaaagacaatatgtcatctttttgagaattttattcacttcaaaacacattaaacacacatatgtacaaaggcattccagagcccagttttcgaggctgaggaaagaccccgagagcgcttcgcacagcacgcttcccagcgtccgaaacactgctctcagggcggggcacagcggaagggctgcacctctcagggttccctaacttttcccttattcagtcatctagacagcaaatacacagtaattccccagtttcctattgacgtcccagcggaagtctgactcctgcgcgtcacgcagtttctgaggcaacgaatctctggcacggaagcttttcctggcgcgtttcgggagaaccacgccaactacaacgtccctcaccagaattcaatgaggcagagtccctgcatctgctccctgcctggcctgggctcccacatccacagaagcgccacagccggggagcttcggagtcaccgcacagagtgtgctctctgctctgcgctcctcagtcccacagtcccctccaagtcacgggagctggaggccaaggagcccctgccacctgcagtctcactccaggtcagaatcgctgtcctctgaggaggaggaaacctgaaggtcctcatagaggacgctcggtgggacacgaacacagggagcctcagacttctctgacacatgagggctctgagcgaggaaggctcccggcttctcaggagagtgaaatgagggggcggccaggaggctggagctccagcgtccgttttccagtctccggaagagcactctgagaggctgggccccatcatggccggccgctgggtgatgggacatggtgcaggcctgggcagtaggcaggcaaggtgtgctgtgcggaggctgccggtcgacgctgggcacctgggccggtgtcctcctgcccatctggggcgacgtacttggtccaagttcggttgcggctggcggaggttggagattctccggggcccgcagctcacctccctggatggcgctttcggggatctggaagggacccagtctcggtttcttggggaagttcaggcaagcctgaatcggagcctgggcaggtctcttggctcctggcccgaagctgagattggagcctaggcccaagctgtgtgtggcggctggcgggcagggctgtgaggtcaccgcaggacgtttgtcttgtgcctggggtctgacggcctggagcaggccgtgggttttggaggcagcctggggaacttctcggcagccaccctcagggctgctgtgtgtcggcttcaccacgaggagaggctcggggccctggtgcctgaatgcaggctgagggatgtcggccgcagcccctgtctgtctttcctttggtccaagacttgaggaggagctcaggctggcttttctgaggggagacagtgaagccaagacggagcccctgccagacatttcggtagctgagcgatcagcgaggacagggtccacgcgcggcctcttactggttgtgtggaccggcattggcccgcttgcaacctgaaagagaggaaacaacacaggttagaagttccacggcatggagccaacgtgaaaatcaaacatatccaaagacaaggtgcacacgccatgaaattcttagtacagtatcgacaggcggtccttggaagtagggacagatccctccacctgagtgctgatcaggacaagacacatgaaaggtgcgctctcgagctatgtgtagctgatctaagcacaccattgttcaaaagatcgcgtcttgggcattaactggatcaaagcgcctccactcagccttccatgaagtggaacggactaatgcccttcccgaggcaggttggtggctcaagggtactcgggacgtcttctctgaacacatgcatgttcctgggtttagccttctccacgtttggggcctctgagggactaatttcctcatgccgctaggaacgtgttgttggcaggcttgccataattggacagaaagaaagccacaggaaatacggcatcttcagatgccttcgcctggaatccaattgacctggaaggattgtggagtccctgaccccaagaaggcaagaaagaggggttccccgatttcctcccacagacgggaagctgaaaggaaatcaaccagggtgacctagaggagaaaaggaccaggggcccggggtgacactcaccctcagatgctcagaagattccgtggatccttttccattcggcagcggcttctctggaggtttcccggaaaacatgtggaggagagccttcctctgcgggtcttgttgcctgcagaacagaaaaaggtcaggcggtgccccctggttttccccaggagacagggagaaccccgtctggggcccagccccattccgtgttttgtgatacagaaatggacatctggtgccctttccgcctctgcaccttccctcacgtgccaaccttcccatcctccaggtggccctctaggcttcccgactaaggactgtgatttggattccatcgcttttcccgctgtcgtggggaacctgcacgaagcgcccccgcctctccccgtccctgaatctcccagagcccaaggagctcctgggtgtggaaccccggaggacacggagctccggcctatttctctgcagcgctccttccctggcccggagacggaaaggcacacggtgtgcaggtgcagagacaccatctccttaggaggcagcaccctaagagtggtgaaaccctcccactgctcaccttggtctctcttccttctctcccttatccttgtttcagggcccccgggttggcttcagcccggggcttccatggtttcaggttttccttcccttccttttttccccaggtcgctggaaccagggctgccttccagcacttcatggggcacctggtacttctggccgtgtggccaaaggccccgcagtttttgcacttgagctgtgggtggaaaggaagtgatgtcagtgagtgagctgaagccacaggcagcgatcccacgtcaacattgggacggattgtgaattcagagctgaataaggattccgaagaggggacaccggcatgggggccgttaagtgctgggagagttcggatacgatgttccctcgcaaagcccttgtgacggagtaactctgaaaggaaggactcaaggttccaaggggcacgatggtgaagccgatgtcaacaacgcagccaaacgtggctacacaggactcgaagtagaaagggaggttgcccccaagagtctctcaagggacctatcgggccggggagaaggtcccaagccacgcccaccttggatgggaaaagcaacctggctggtggtgacagaactctttggaatccaacccagtctctgaggaccgtgggacaccgcctccccccgtccccacccccaccccgatacccaagagatccagggctagacttaccctgggatcttcttcatcgggcgggggagaccttggcccaactggggccctccgctgcttctggagggtctgggctctcaccagtctcttggcccaagatttggggtcccgacgtgccatcatcttcgtctcctgggggttttatgaccgcctttttcaggggtggactgttgggccacctgaaacacacacaaacacacacatgtcgatggttaagcacgttggatattcacacacccacaggaagccacctgctaactccctgcctgtgtggtcatgaggagacctcaccaccagtcggtcaaatctgtagaacacaatgtgctgtgcgcatcctcggatattgtgtgttcctctgccatgactacctagtccaagagtaaaccccacctgccacagggcccgtggcctaggtatggggggttgagctttcaaccccaaacaaacaactgattctggagactggacttaggtctctcacgattcactccggtagaagacacggtgattctatctcccttgacggacagaatgatcgaagacacagggcatggcgtgtgccaccctttggcaggtctgcttgaagtcacggataagggatgcttcctgtgacaacttgaatcgctactcttgccatttcattaggcaacttccaaacacaaattcatacagagaagttaccttcctctctaccgcactagcaggtgatggtctttcctgttctatcttttggctttagctccagcccctctttatttattttcctggtattttacgcacaccacacgaattcatctgaacaaacgggggaagaagtgccgtatcgtatcgacgtcttacacggctgaagggcaaaacccccttttttccaaagtcctttttccatttacccaccaattcagcatgctgcagtacatttcttttcgcattcccatcttggtcttctcccacacgtggagacggatatgttttctcgttttctgttccaagaattactagtaacgagaacacatcctaccccaccaccaagccccagtgtgatcggtttctttcctcctttgtctcttcctccccccgccccccccccgccaaaaccactcagggattgcgtgaaacaaacaattgttcagcgaaactaacctgaaattacacgtctactttctttcccaggctggcgctgagatgggcaggtgctgcagcagcccggctggaagcgatgcagcatccaggacgacggaggaaggggcagagagggacctccgctttccaggctgccttttatactgcctctggtcacctgacatggaacgtaccctaacctaatcagttacctgtaccttaattgcaattaacttaatccaattacatgacctggaaaggtctatctgcacagcccactctaagatcatgtccactgctgacagacattctaaaacctacttgtacagctgcaagctttgaacaatagatgttccccgtcagacatgtaacactggtgcctgtacccgtcttcttttccatcttttttgtcgtttagttttgttttgttttaaaaaatgtggtaaaatagacaccttttaattggaccacattttgtctatctcgacgtaggcctcagtgtcatcaaggagactctccttgacatgcagtcacggccatgatccatcttcagagcttctctttcttccccaaggtaagtctgtcagcagagaaccctgaccgcaccctcatgtgttttctcccccaggaggcgcttggaaaccaccgtgaattggaccgcactgggaaacacagatgaggaaagtcaacaacgctttgtccttcagtgcctggctcctttttcagctcctcttgcgactccaggcattatgcctgaaaagtctcccggacgcctgtgaggctctaattccctgggtcccattgccatgtctctggatttgcgaagatccaccgcaccttctgtggaactcccgtgtcggtgaactttagtgccacggcccctaattctgcccatggtcatccgcacctgcacgacttagggtccatgttccttggacgggaagagacaggcaggagtcggaatgatgaaccagcacactggggcgttttctcatgtagcccaagtgaccccatggtcttctcgagctttggaaccagtcgcgtcccctttgacactgcacccggctcccagtctctcaatcttgttggccctccggcgatctcccgttggatgaattgctcctgctgaaactcgagtcccctttgatttgcgcttcattaattattcatgattcaggttggaaggcctgctgacgaccccctgtggccgttctctgagctttcctgtcacatcgtttccttccacgctctttggttccttatggtcctgctccttctgctgtcagaggagcagagagttgatcttattcattctggatacggatactttctaggtgatctggataatcaagataacgaccctcaacagcggcggaaagggagcagccagttggtgtgtctcagaaaatcccgctgagttccgaggcctcctagatgtggaatcctgctgagagttggtcccaggtcagagaatggagagagcctgtgcatgatgggatatccccgcctagatcttttagtgagtctctgcctcagctactcttaggatcagggggagaaccatggtgtcagacatccggaaagaagacgggatgaatgttttacctctgaagtacatcccaaatgtgggagttaacttcagctttgctggggtctatttggccagtgaaactctgcctggttccttcgcacatccggaagccacttcacggggggccgtcgcaactggaaccacacacttggcatcggcggttgagccaaatggggactcgtggtgcaagcaacgctccccacgtgttagcgtgcgtgagattcggttggcggaattttactaggtgcgtgttggtagagtggggctgaggttttcttgctcctgtggatgtataggaagtcaaaggtcctgcccagccctgcggtcccctcagtcaactctgtttcggagaggtaacgatttggattgccaacaaatcaagaaatgttcaagcccttggatgtagggtaaagaaagagagatcggactgtcactgtgtctatgtagaaggggaagacataagagactccattttgaaaaagacctgtactttaaacaattgcttcactgagatgttgatcatttgtagctttgccgcagccccttcctttgacccaacttggagctcacaaaaacctgtgttgtataaaatcgaggtttaagggatctagggctgtgcaggacgcgccttgttaaccaaatgtttacgagcagtatacttggtagaagtcattgccattctctagtctcaataaaccaggggcgcaatgtaccgtggaaagccacagggacctctgcccttgaaagcagggtattgtccaaggtttctccccatgtgacagtctgaaatatggcctcgtgggatgggaaagtcctgaatgtcccccagcctgacacccgcaatgggtctgtgctgaggtggattagtcaaagaggaacgcctcttgcagttcaaatggaggaaggccactgtctcctgcttgcccctgggaactgaatgtctcggtgtaaagcccgatcgtacatttgttcaactctgagctcggagaaaagctgccctgtggcgggaggtgagacatgttggcagtaatgctgccttgctttctttactccgctgagatatttgtgtggagagaaacataaatctggcctacgtgcacgtccaggcatagtaccttcccttgaacttaataatgatatggattcttttgctcacgtgtttgttttttgttgttgttgttgaccttccccttattatcaccctgctcccctactgcattcctttgtgctgaaataatgaaaatcataatcaataaaaacagagggaactcagaggccggtgccggtgcaggtcctaggtgtgctgagtgcctgtcccctggacccactgttgtctccctatactttgtctctgtgtcttatttcttttctccgtctctcatcccacccgactagaaacacccacaggtgtggaggggcaggccaccccttcacttggaaaatcagttacacacaaacacggaatgagagtcaaaagacaatatgtcatctttttgagaattttattcacttcaaaacacattaaacacacatatgtacaaaggcattccagagcccagtttccgaggctgaggaaagaccccgagagcgcttcgcacagcacgcttcccagcgtccgaaacactgctctcagggcggggcacagcggaagggctgcacctctcagggttccctaacttttcccttattcagtcatctagacagcaaatacacagtaattccccagtttcctattgacgtcccagcggaagtctgactcctgcgcgtcacgcagtttctgaggcaacgaatctctgtcacggaagcttttcctggcgcgtttcgggagaaccacgccaactacaacgtccctcaccagaattcaatgaggcagagtccctgcatctgctccctgcctggcctgggctcccacatccacagaagcgccacagccggggagcttcggagtcaccgcacagagtgtgctctctgctctgcgctcctcagtcccacagtcccctccaagtcacgggaactggaggccaaggagcccctgccacctgcagtctcactccaggtcagaatcgctgtcctctgaggaggaggaaacctgaaggtcctcatagaggacgctcggtgggacacgaacacagggagcctcagacttctctgacacatgagggctctgagcgaggaaggctcccggcttctcaggagagtgaaatgagggggccgccaggaggctggagctccagcgtccgttttccagtctccggaagagcactctgagaggctgggccccatcatggccggccgctgagtgatgggacatggtgcaggcctgggcagtgggcaggcaaggtctgctgtgcggaggctgcctgtcgacgctgggcacctgggccggtgtcctcctgcccatctggggcgacgtacttggtccaagttcggttgcggctggcggaggttggagattctccggggcccccagctcacctccctggatggcgctttcggggatctggaagggacccagtctcggtttcttggggaagttcaggcaagcctgaatcggagcctgggcaggtttcttggctcctggcccgaagctgagattggagcctaggcccaagctgtgtgtggcggctggcgggcagggctgtggggtcaccgcaggacgtttgtcttgtgcctggggtctggaggcctggagcaggccgtgggttttggaggcagcctggggaacttcttggcagccaccctcggggcggctgtgtgtcggcttcacctcgagaagaggctcggggccctggtgcctgactgcaggctgaggcatgtcggccgcagccccagtctgtctttcctttggtccaagacttgaggaggagctcaggctggtttttctgaggggagacagtgaagccaagacggagcccctgccagacatttcagttgcggagcgatcagcgaggacagggtccaagcgcggcctcttactggttgtgtggaccggcattggcccgcttgcaacctgaaagagaggaaacaacacaggttagaagttcctcagcatggagccaacgtgaaaatcaagcacatccaaagacaaggtgcacacgccatgaaattcttagtacagtatcgacaggcggtccttggaagtagggacagaccctccacctgagtgctgatcaggacaagacacatgaaagatgcgctctcgagctatgtgtagctgatctaagcacaccattgttcaaaagatcgcgtcttgggcattaactggatcaaagcgcctccactcagccttccatgaagtggaacggactaatgcccttcccaaggcaggttgctggctcaagggtactcgggacgtcttctctgaacacatgcctgttcctgggtttcgccttctccacgtttggggcctctgagggactaatttcctcatgccgctaggaacgtgttgttggcaggcttgccataattggacagaaagaaagcaacaggaaatacggcatgttcagatgccttcgcctggaatccaattgacctggaaggatcgtggagtccctgaccccaagaaggcaagaaagaggggttccccgatttcctcccgcagacgggaagctgaaaggaaatcaaccagggtgacctagaggagaaaaagaccaggggcccggggtgacactcgccctcagataatcagaagattccgtggatccttttccatttggcagcggcttctctggaggtttcccggaaaacatgtggaggagagccttcctctgcgggtcttgttgcctgcagaacagaagaaggtcaggccgtgccccctggttttccccaggagacagggagaaccccgtctggggcccagccccattccgtgttttgtgatacagaaatggacatctggtgccctttccgcctctgcaccttccctcacgtgccaaccttcccatcctccaggtggccctctaggcttcccaactaaggactgtgatttggattccatcgcttttcccgctgtcgtggggaacctgcacgaagcgcccccgcctctccccgtccctgaatctcccagagcccaaggagctcctgggtgtggaaccccggaggacacggagctccggcctatttctctgcagcgttccttccctggcccggagacggaaaggcacacggtgtgcaggtgcagagacaccatgtccttaggaggccgtaccctaagagtggtgaaaacccctcccactgctcaccttggtctctcttccttctctcccttatccttgttcaagggccccgggttggcttcagcccggggcttccatggtttcaggttttccttcccttcctttttccccaaggtcgctggaaccagggctgccttccagcacttcatggggcacctggtacttctggccgtgtggccaaaggccccgcagtttttgcacttgagctgtgggtggaaaggaagtgatgtcagtgagtgagctgaagccacaggcagcgatcccacgtcaacattgggacggattgtgaattcagagctgaataaggattccaaagaggggacaccggcatgggggccgttaagtgctgggagacttcggatacgatgttccctcgcaaagcccatgtgacggaggaactctgaaaggaaggactcaaggttccaaggggcacgatggtgaagccgatgtcaacaacgcagccaaacgtggctacacaggactctaagtagaaagggaggttgcccccaagagtctctcaagggacctatcgggccggggagaaggtcccaagccacgcccaccttggatgggaaaagcaacctggctggtggtgacagaactctttggaatccaacccagtctctgaggaccgtgggacacccccttccccccgtccccacccccaccccgatacccaagagatccagggctagacttaccctgggatcttcttcatcgggcgggggagcccttggcccaactcgggccctccgctgcttctggagggtctgggctctcaccagtctcttggcccaagatttggggtcccgacgtgccatcatcttcgtctcctgggggttttatgaccgcctttttcaggggtggactgttgggccacctgaaacacacacaaacacacacatgtcgatggttaagcacgttggatattcacacacccacaggaagccacctgctaactccctgcctgtgtggtcacgaggagacctcaccaccagtcggtcaaatctgtagaacacaatgtgctgtgcgcatcctcggatattgtgtgttcctctgccatgactacctagtccaagagtaaaccccacctgccacagggcccgtggcctaggtatggggggttgagctttcaaccccaaacaaacaactgattctggagactggacttaggtctctcacgattcactccggtagaagacacggtgattctatctcccttgacggacagaatgatcgaagacacagggcatggcgtgtgccaccctttggcaggtctgcttgaagtcacggataagggatgcttcctgtgacaacttgaatcgctactcttgccatttcattaggcaacttccaaacacaaattcatacagagaagttaccttcctctctaccgcactagcaggtgatggtctttcctgttctatcttttggctttagctccagcccctctttatttattttcctggtattttacgcacaccacacgaattcatctgaacaaacggggaagaagtgccgtatcgtatcgacgtcttacacggctgaagggcaaaacccccttttttccaaagtcctttttccatttacccaccaattcagcatgctgcagtacatttcttttcgcattcccatcttggtcttctcccacacgtggagacggatatgttttctcgttttctgttccaagaattactagtaacgagaacacatcctaccccaccagcaagccccagtgtgatcggtttctttcggcctcctttgtctcttcctccccccgccccccccccgccaaaaccactcagggattgcgtgaaacaaacaattgttcagcgaaactaacctgaaattacacgtctactttctttcccaggctggcgctgagatgggcaggtgctgcagcagcccggctggaagcgatgcagcatccaggacgacggaggaaggggcagagagggacctccgctttccaggctgccttttatactgcctctggtcacctgacatggaacgtaccctaacctaatcagttacctgtaccttaattgcaattaacttaatccaattacatgacctggaaaggtctatctgcacagcccactctaagatcatgtccactgctgacagacattctaaaacctacttgtacagctgcaagctttgaacaatagatgttccccgtcagacatgtaacactggtgcctgtacccctgtcttcttttccatcttttttgttgttttgttttgttttgttttaaaaaatgtggtaaaatagacaccttttaattggaccacattttgtctatctcgacgtaggcctcagtgtcatcaaggagactctccttgacatgcagtcacggccatgatccatcttcagagcttctctttcttccccaaggtaagtctgtcagcagagaaccctgaccgcaccctcatgtgttttctcccccaggaggcgcttggaaaccaccgtaaattggaccacactgggaaacacagatgaggaaagtcaacaacgctttgtccttcagtgcctggctcctttttcagctcgtcttgcgactccaggcattatgcctgaaaagtctcccggacgcctgtgaggctctaattccctgggtcccattgccatgtctctggatttgcgaagatccaccgcaccttctgtggaactcccgtgtcggtgaacttttgtgccacggcccctaattctgcccatggtcatccacacctgcacgacttaggttccatgttccttggacgggaagagacaggcaggagtcggaatgatgaaccagcacactggggcgttttctcatgtagcccaagtgaccccatggtcttctcgagctttggaaccagtcgcgtcccctttgacactgcacccggctcccagtcactcaatcttgttggccctcaggcgatctcccgttggatgaaatgctcctgctgaaactcgagtcccctttgatttgccttcattaattattcatgattcaggttggaaggcctgctgacgaccccctgtggccgttctctgagctttcctgtcacatcgtttccttccacgctctttggttccttacggtcctgctccttctgctgtcagaggagcagagagttgatcttattcattctggatacggatactttctagttgatctggataatcaagataacgaccctcaacagcggcggagagggagcagccagttggtgtgtctcagaaaatcccgctgagttccgaggcctcctagatgtggaatcttactgagagttgttcccaggtcagagaatggagagagcctgtgcatgatgggatatccccgcctagatcttttagtgagtctctgcctcagctactcttaggatcagggggagaaccatggtgtcagacatccggaaagaagacgggatgaatgttttacctctgaagtacatcccaaatgtgggagttaacttcagctttgctggggtctatttggccagtgaaactctgcctggttccttcgcacatccggaagccacttcacggggggccgtcgcaactggaaccacacacttggcatcggcggttgagccaaatggggactcgtggtgcaagcaacgctccccacgtgttagcgtgcgtgagattcggttggcggaattttactaggtgtgtgttggtagagtggggctgaggttttcttgctcctgtggatgtataggaagtcaaaggtcctgcccagccctgcggtcccctcagtcaactctgttttggagacgtaacgatttggattgccaacaaatcaagaaatgttcaagcccttggatgtagggtaaagaaagagagatcagactgtcactgtgtctatgtagaaggggaagacataagagactccattttgaaaaagacctgtactttaaacaattgctttactgagatgttgatcatttgtagctttgccgcagccccttcctttgacccaacttggagctcacaaaaacctgtgttgtataaaatcgaggtttaagggatctagggctgtgcaggacgcgccttgttaaccaaatgtttacgagcagtatacttggtagaagtcattgccattctctagtctcaataaaccaggggcgcaatgtaccgtggaaagccacagggacctctgcccttgaaagcagggtattgtccaaggtttctccccatgtgacagtctgaaatatgacctcgtgggatgggaaagtcctgaatgtcccccagcctgacacccgcaatgggtctgtgctgaggtggattagtcaaagaggaacgcctcttgcagttcaaatggaggaaggccactgtctcctgcttgcccctgggaactgaatgtctcggtgtaaagcccgatcgtacatttgttcaactctgagctcggagaaaagctgccctgtggcgggaggtgagacatgttggcagtaatgctgccttgctttctttactccgctgagatatttgtgtggagagaaacataaatctggcctacatgcacgtccaggcatagtaccttcccttgaacttaataatgatatggattcttttgctcacgtgtttgttttttgttgttgttgttgaccttccccttattatcaccctgctcccctactgcattcctttgtgctgaaataatgaaaatcataatcaataaaaacagagggaactcagaggccggtgccggtgcaggtcctaggtgtgctgagtgcctgtcccctggacccactgttgtctccctatactttgtctctgtgtcttatttcttttctccgtctctcatcccacccgactagaaacacccacaggtgtggaggggcaggccaccccttcacttggaaaatcagttacacacaaacacggaatgagagtcaaaagacaatatgtcatctttttgagaattttattcacttcaaaacacattaaacacacatatgtacaaaggcattccagagcccagttttcgaggctgaggaaagaccccgagagcgcttcgcacagcacgcttaccagcgtccgaaacactgctctcagggcggggcacagcggaagggctgcacctctcagggttccctaacttttcccttattcagtcatctagacagcaaatacacagtaattccccagtttcctattgacgtcccagcggaagtctgactcctgcgcgtcacgcagtttctgaggcaacgaatctctgtcacggaagcttttcctggcgcgtttcgggagaaccacgccaactacaacgtccctcaccagaattcaatgaggcagagtccctgcatctgctccctgcctggcctgggctcccacatccacagaagcgccacagccggggagcttcggagtcaccgcacagagtgtgctctctgctctgcgctcctcagtcccacagtcccctccaagtcacgggaactggaggccaaggagcccctgccacctgcagtctcactccaggtcagaatcgctgtcctctgaggaggaggaaacctgaaggtcctcatagaggacgctcggtgggacacgaacacagggagcctcagacttctctgacacatgagggctctgagcgaggaaggctcccggcttctcaggagagtgaaatgagggggccgccaggaggctggagctccagcgtccgttttccagtctccggaagagcactctgagaggctgggccccatcatggctggccgctgggtgatgggacatggtgcaggcctgggcagtaggcaggcaaggtctgctgtgcggaggctgccggtcgacgctgggcacctgggccggtgtcctcctgcccatctggggcgacgtacttggtccaagttcggttgcggctggcggaggttggagattctccggggcccccagctcacctccctggatggcgctttcggggatctggaagggacccagtctcggtttcttggggaagttcaggcaagcctgaatcggagcctgggcaggtctcttggctcctggcccgaagctgagattggagcctaggcccaagctgtgtgtggcggctggcgggcagggctgtggggtcaccgcaggacgtttgtcttgtgcctggggtctggcggcctggagcaggccgtgggttttggaggcagcctggggaacttctcggcagccaccctcggggcggctgtgtgtcggcttcaccacgaggagaggctcgcggccctggtgcctgactgcaggctgaggcatgtcggccgcagccccagtctgtctttcctttggtccaagacttgaggaggagctcaggctggcttttctgaggggagacagtgaagccaagacggagcccctgccagacatttcggttgcggagcgatcagcgaggacagggtccaagcgcggcctcttactggttgtgtggaccggcattggcccgcttgcaacctgaaagagaggaaacaacacaggttagaagttcctcagcatggagccaacgtgaaaatcaagcacatccaaagacaaggtgcacacgccatgaaattcttagtacagtatcgacaggcggtccttggaagtagggacagaccctccacctgagtgctgatcaggacaagacacatgaaagatgcgctctcgagctatgtgtagctgatctaagcacaccattgttcaaaagatcgcgtcttgggcattaactggatcaaagcgcctccactcagccttccatgaagtggaacggactaatgcccttcccaaggcaggttgctggctcaagggtactcgggacgtcttctctgaacacatgcatgttcctgggtttcgccttctccacgtttggggcctctgagggactaatttcctcatgccgctaggaacgtgttgttggcaggcttgccataattggacagaaagaaagcaacaggaaatacggcatgttcagatgccttcgcctggaatccaattgacctggaaggatcgtggagtccctgaccccaagaaggcaagaaagaggggttccccgatttcctcccgcagacgggaagctgaaaggaaatcaaccagggtgacctagaggagaaaaagaccaggggcccggggtgacactcgccctcagataatcagaagattccgtggatccttttccattcggcagcggcttctctggaggtttcccggaaaacatgtggaggagagccttcctctgcgggtcttgttgcctgcagaacagaagaaggtcaggccgtgccccctggttttccccaggagacagggagaaccccgtctggggcccagccccattccgtgttttgtgatacagaaatggacatctggtgccctttccgcctctgcaccttccctcacgtgccaaccttcccatcctccaggtggccctctaggcttcccaactaaggactgtgatttggattccatcgcttttcccgctgtcgtggggaacctgcacgaagcgcccccgcctctccccgtccctgaatctcccagagcccaaggagctcctgggtatggaaccccggaggacacggagctccggcctatttctctgcagcgttccttccctggcccggagacggaaaggcacacggtgtgcaggtgcagagacaccatgtccttaggaggccgtaccctaagagtggtgaaaacccctcccactgctcaccttggtctctcttccttctctcccttatccttgttcaagggccccgggttggcttcagcccggggcttccatggtttcaggttttccttcccttcctttttccccaaggtcgctggaaccagggctgccttccagcacttcatggggcacctggtacttctggccgtgtggccaaaggccccgcagtttttgcacttgagctgtgggtggaaaggaagtgatgtcagtgagtgagctgaagccacaggcagcgatcccacgtcaacattgggacggattgtgaattcagagctgaataaggattccaaagaggggacaccggcatgggggccgttaagtgctgggagacttcggatacgatgttccctcgcaaagcccatgtgacggaggaactctgaaaggaaggactcaaggttccaaggggcacgatggtgaagccgatgtcaacaacgcagccaaacgtggctacacaggaacctaagtagaaagggaggttgcccccaagagtctctcaagggacctatcgggccggggagaaggtcccaagccacgcccaccttggatgggaaaagcaacctggctggtggtgacagaactctttggaatccaacccagtctctgaggaccgtgggacacgcctccccccgtccccacccccaccccgatacccaagagatccagggctagacttaccctgggatcttcttcatcgggcgggggagaccttggcccaactggggccctccgctgcttctggagggtctgggctctcaccagtctcttggcccaagatttggggtcccgacgtgccatcatcttcgtctcctgggggttttatgaccgcctttttcaggggtggactgttgggccacctgaaacacacacaaacacacacatgtcgatggttaagcacgttggatattcacacacccacaggaagccacctgctaactccctgcctgtgtggtcatgaggagacctcaccaccagtcggtcaaatctgtagaacacaatgtgctgtgcgcatcctcggatattgtgtgttcctctgccatgactacctagtccaagagtaaaccccacctgccacagggcccgtggcctaggtatggggggttgagctttcaaccccaaacaaacaactgattctggagactggacttaggtctctcacgattcactccggtagaagacacggtgattctatctcccttgacggacagaatgatcgaagacacagggcatggcgtgtgccaccctttggcaggtctgcttgaagtcacggataagggatgcttcctgtgacaacttgaatcgctactcttgccatttcattaggcaacttccaaacacaaattcatacagagaagttaccttcctctctaccgcactagcaggtgatggtctttcctgttctatcttttggctttagctccagcccctctttatttattttcctggtattttacgcacaccacacgaattcatctgaacaaacggggaagaagtgccgtatcgtatcgacgtcttacacggctgaagggcaaaacccccttttttccaaagtcctttttccatttacccaccaattcagcatgctgcagtacatttcttttcgcattcccatcttggtcttctcccacacgtggagacggatatgttttctcgttttctgttccaagaattactagtaacgagaacacatcctaccccaccagcaagccccagtgtgatcggtttctttcggcctcctttgtctcttcctcccccacaccccccgcaaatacccctcagggattgcgtgaaacaaacaattgttcagcgaaactaacctgaaattacacgtctactttctttcccaggctggcgctgagatgggcaggtgctgcagcagcccggctggaagcgatgcagcatccaggacgacggaggaaggggcagagagggacctccgctttccaggctgccttttatactgcctctggtcacctgacatggaacgtaccctaacctaatcagttacctgtaccttaattgcaattaacttaatccaattacatgacctggaaaggtctatctgcacagcccactctaagatcatgtccactgctgacagacattctaaaacctacttgtacagctgcaagctttgaacaatagatgttccccgtcagacatgtaacactggtgcctgtacccctgtcttcttttccatcttttttgttgttttgttttgttttgttttaaaaaatgtggtaaaatagacaccttttaattggaccacattttgtctatctcgacgtatgcctcagtgtcatcaaggagactctccttgacatgcagtcacggccatgatccatcttcagagcttctctttcttccccaagttaagtctgtcagcagagaaccctgaccgcaccctcttgtgttttctcccccaggaggcgcttggaaacaaccgtgaattggaccgcactgggaaacacagatgaggaaagtcaacaacgctttgtccttcagtgcctggctcctttttcagctcgtcttgcgactccaggcattatgcctgaaaagtctcccggacgcctgtgaggctctaattccctgggtcccattgccatgtctctggatttgcgaagatccaccgcaccttctgtggaactcccgtgtcggtgaacttttgtgccacggcccctaattctgcccatggtcatccgcacctgcacgacttagggtccatgttccttggacgggaagagacaggcaggagtcggaatgatgaaccagcacactggggcgttttctcatgtagcccaagtgaccccatggtcttctcgagctttggaaccagtcgcgtcccctttgacactgcacccggctcccagtcactcaatcttgttggccctccggcgatctcccgttggatgaattgctcctgctgaaactcgagtcccctttgatttgcgctccattaattattcatgattcaggttggaaggcctgctgaagaccccctgtggccgttctctgagctttcctgtcacatcgtttccttccacgctctttggttccttacggtcctgctccttctgctgtcagaggagcagagagttgatcttattcattctggatacggatactttctagttgatctggataatcaagataacgaccctcaacagcggcggaaagggagcagccagttggtgtgtctcagaaaatcccgctgagttccgaggcctcctagatgtggaatcctgctgagagttggtcccaggtcagagaatggagagagcctgtgcatgatgggatatccccgcctagatctttcagtgagtctctgcctcagctactcttaggatcagggggagaaccatggtgtcagacatccggaaagaagacgggatgaatgttttacctctgaagtacatcccaaatgtgggagttaacttcagctttgctggggtctatttggccagtgaaactctgcctggttccttcgcacatccggaagccacttcacggggggccgtcgcaactggaaccacacacttggcatcggcggttgagccaaatggggacttgtggtgcaagcaacgctccccacgtgttagcgtgcgtgagattcggttggcggaattttactaggtgcgtgttggtagagtggggctgaggttttcttgctcctgtggatgtataggaagtcaaaggtcctgcccagccctgcggtcccctcagtcaactctgtttcggagacgtaacgatttggattgccaacaagtcaagaaatgttcaagcccttggatgtagggtaaagaaagagagatcagactgtcactgtgtctatgtagaaggggaagacataagagactccattttgaaaaagacctgtactttaaacaattgctttgctgagatgttgttcatttgttgccttgcctcatccactttgccccagcccccttgacccaacttggagctcagaaaacctgtgttgtataaaatcgaggtttaagggatctagggctgtgcaggacgtgctttgttaaccaaatgtttgcgagcagtatacttggtaaaagtcattgccattctctagtttcaataaaccaggggcactatgcaccgtcgaaagccgcagcgacctctgcccttgaaagcaggttattgtccaaggtttctccccatgtaacagtctgaaatatggcctcgtgggatgttaaagacctgactggcccccagcctgagacccgtaaagggtctgtgccgaggtggattagtcaaagaggaaagcctcttgcaatttagatggaggacagccgctgtctcccgcagcccctcttgcttccctggctcttaggacccccatcgcagggtgtgaggcactccccccatttcgggttgtaagagccaaaccctcttgcccccctggctcttagtttcccccatcgcagcggggtgagtcacgtcctgctatgcttggggtaagagccagcccctcttgcccccctggctctcaggacccccatcgcagtggtgtgaggcacgccccttgatgcgggtattaagagccttcccatcttacctcctggctcttaggacccccatcgcagggggtgaggcacgccccgccatgcggagagtaagagctaacccctcttgcccccctggtttttaggatccgcggtggactcacagcctgtttatcatattgtgagtaatatcgtctcccgctctggagattgtgaactgtttcacccaccggtgttcaccccggcgtacagaggttgtacacccgtctgtattgggagtcatatcatcctcttcctctctgaatattaagaacagtatcacaggggtgtttctactccctgggatatcgcgtgtcatatcatcctctcccacgttgcaattagaaacaatatcagtgggggcgtgtccaccttctgtgatactgaaagtaatatcatcctcttccctccaggatcgtgggaacaatatccttgggggtgtccactttctgccatatgtgtagtcatatcaccccctccgccttggaatattattaagaaccatgtcacacgggggtgtacacttcctacgatgttgggagtaatagcattctcttcttccatgaatgttaggaacaaaatcaccgggtggatgcacacccagtgctatattgggagtaatgttatactccaccccctggagattatattcggatcaatatcaccggctgggtgtgcacctgctgcgatattgtacgtaatatcatgctctctcactccctgaacattaggaacaatatcacaggtgggtgtacacccactgaggtattagggcatactattagtatgaattattccttgttttttattaacatgaatatgaatggccgatattaatattaatattaagaagtaattgctaataaaaagttctcagattattaatattaatattaattattaggagctaatattactattttctaatgaataagatccgtatcagttattaatatcaggcgtcataatcattaatattaatcatgtattgttattgttagtataactatttaatattaattatcattagtatcggtattgattttaaaaattatattatgggttattaatattgataattattagtgtcagttaataattgagattattaattgcggtaagtcgcattgcgccattccaccccttcctcggcagctcgtttacgacccaaaacggggacacaaatgcccctgagagagcagcggtatactgggatagatgaaaatgctcatgtagtggagagacgtgtttttgggtaccagcccttcacctgcgtcgaccttctcaactggaaaaacaatacatcgccctataccgaaaagccacaagccctaattgatttgctccaaactgttatccagacccacaaccacacctggaccgattggcaccagttgctcattttcctctttaacagtgaagaaaggcagagagtcctccaagcagcaactaagtggctagaggaacatgcaccagctgattatcaaaacccccaatagtatggaaggacccagttgccaggaaccgacccccagttggacccacatgaaagagaggagatgcaaaggctaaaccgagacagggaagctctcttggaaggattaatgaggggagctcagaaggccacaaacgttaacaagctctctgaggtcattcagggaaaagaagaaagtccagcacaattctacgagagactgtatgaggcctatcatatgtatactccctttgatcccgatagccctgaaaatcagcgcatgattcacatggctttagtccatcaaagtgcagaagacatgagaagaaaactgcagaaacagactgggcttgcagggaagaatccatcccaattactagaaatagctagccaggtgtttgtaaacaggtatgcagtaagccgtaaggaaaacggcaaagaggatggaggtcagtcccggccacacgccgacctgtttgtcagctgcagcaatcagaggggcccccgcaaagaggcaagggaaagggggccctgggaaagaaactcagcttggctgtcagagtttgcagcgtaaccagtgtgctgattgtaaagaaataggacagtggaagaacaaatgccctcagctcaaaagaaaagaaggtgactcagagccggaggccccggacaaggaggaaggggccctgctcaacctggcagaagggttcttggactgagggagaccgggctcaagcatccccattctgacatctgttcagaatgacagtcaggggtggagacattaactttcttgtagatagcggtgctgaacattcgctagtaaccgccccggtcgtccccttaccgaaaaagactactgacgtcatcggagccacgggggtttcagcaaagcaagctttctgcttgccttggacttgtcctgtaggaggacataaagtcattcatcagttttgttacatgcctgacagtctcttgaacttttcaggaagggacttgctcagcaagctgagagccactgcctctttcacagagcatggctctttgctgctaaagttacccggaatgggagtcattatgacgcttatggtcccccgagaggaggaatggagacttttctgaactgacccgggcaaagagaaaagaccagctctggctaagcgctggccaagagttcgggcagaagagaaccctccaggattggccagttaagactggggcccagccggtgaggcaaaaaccggactcggtccccagagaagcccttcaaggtatccaggtccatctcaagcacctaagaacgtttggaatgattgttccttgtcagtctccatggaacactcccctcctgcctgttcccaagccacggaccaaggactaccggccggtacaggatttgcgcttgcttcatcaagccacactgactttacatccaacagtacctaacccgtccacattgttggggttgccgccagctgaggacagctggttcacctgcttggacctaaaagacgctttccttcctatcagattagcccctgagaggcagaagctgtttgcctttcagtgggaagatccggagtcaggtgtcactacttagtacacttggaccgggcttccccaaaggttcaagaactcccccaccatcttcggggaggcatgggctcgagacctccagaagtttcctagcagagacctaggatgcttgttgctccagtaggttgatgaccttctgctgggacaccccacggcagtcgggtgtgccaagggaacagatgccctacaccgcacctggaggactgtgggtagaaggtgtccaagaaaaaagctcagatctgccgacagcaggtacgttacttgggatttactatccgacaggggtcggaacgcagcccgggatcagaaagaaagcaggtcatttgccatctagcggagcctaagagcagaaggcaggtaagagaattcttaggagctgtggggttttgtagactgtggatcccaaactttgcagtattagccaagtttttgtatgaggtcacaaggggggcggggacggtgaatctttggaatgcggatcccaacaacagcaagtatttcatgagttaaaggaaaaacttctggcagcaccagccctgaggctacccgatctgacaaagccttttccattgtatgcatcagagagagaaaggatggcagctggactttgaacccaaactgtggggccctggctgaggctggtggcctacctctgtaaaccactagacggggtttctaaaggatggcccccctgttggagggccttggcagcaactgccctgctagtataagaagcaaataagctgactcttgggcgaaacctgaacataaaggcctcccgtgctgtggtgatgaatactaaaggacgtcattggctaacgaatgccaggctcaccaagtaccaaactttggtctgtgaaaatccccgtataaccattgaagtttgtaacaccctacaccccgccaccttgctgccggtatcagggagccctgtcgagcctgattgtgtagaagtgttggactcaattgactctagcagacctgagctccgggaccagacttgggcatcagtagactgggaaccacacgtggatgggagcagcttcttcaacccccaaggagagagaggtgcagggtatgcagtgataactctggacactgttgttgaaaccaggtcgttgccccaggccacttcagcccagaaagctgaactcaatgctttcatttgggccttagaactcagtgagggtgagactgtcaacacttacactgattctcggtatgtctttttaacccttcaagtgcatggagtgtgatagaaagaaaagggcctattgaattctggggggaaagacagaaaatatccacaagaaatcttgcaatgattagaagcagtatggaaaccccacaaggtggcagttaggcattgcagaggacaccagcgagcttccaccttgctgtgtttggggaattcccgcgctgagtcagaggctcgaaaagcagcaactgcccccttctgggcatcagtgctccctcaagcacctgatcttggacctgcttcttctaaagaagaaaggactttctccaggtagagggaaggacaagtgatggaggaaggatggattcagttaccagataggagagtagctgtgccacagctgctaggagctgcagttgtactggctgtgcaagaaaacacccatcgaggtcaggagtcactggaaaagttgttaggccggtatttctacatctcgcctttgtcaacccttgccaaaacggtgaggcagcggtgtgttacctgctgacagcatgatgggagtcaaggtccagccgttccgcccggcatacgagcttgtggagcagccccctttgaaggtctccaggtggacttcacagagatgccaaagtgtggaggtaacaagcatgtactggttcttgggcgtacctaccctgggtgggtggaggcctatccaacacgaactgagaaagctggtgaagtaacccctgtgcttcttcgagatgtgattcctagatttcgaccgcccttatggatcggctcagacaacgggcctgcgtttttggctgccttggtacagaaaacggcaaaggtattggggatcacacggaaactacatgccgcctcccggcctcagagttccggaaaggtggagaggatgaatcggactatcaaaaatagtactactgtcttccccgctggatatttaaaacaacagcacaaggggcgtcaaaccacctgctaaattggaggcaatgttatcctctcccctcctcccccggccccggatattagagacaacaacacaggggtgatgtacacccactgctttattgtgagtaatatcatcctctcccttcttggatagtaggaacagtatcacactgtgcgtgtaggcctgtcgcgaaattcaatggaatgtcatcctgcgcctccctggatatgacgaacaatatcacgggggatgtacaacttctgagatattgggagtgatgtcatcctctcccctctggaagttagggacaatatcacaggggtagtgtacaccctctgggatgttgggactaatatctcacagatgtctgagaattcctcctcctgggactctcagaggatccagaactgcagccggtcctcgctttgctgtccctgtccctgtccatgtatctggtcacggtgctgaggaacctgctcagcatcctggctgtcagctctgactcccccctccacacccccatgtacttcttcctctccaacctgtgctggcctgacatcggtttcacctcggccatggttcccaagatgattgtggacacgcagtcgcatagcagagtcatctctcatgcgggctgcctgacacagatgtctttcctgctccttgttgcatgtatagaaggcatgctcctgactgtgatggcctatgactgctttgtagccatctgtcgccctctgcactactcaatcatcgtgaatcctcacctctgtgtcttcttcgttttggtgtcctttttccttagcctgttggattcccagctgcacagttggattgtgttacaattaaccatcatcaagaatgtggaaatctctaatttggtctgtgacccctctcaacttctcaaacttgcctgttctgacagcgtcatcaataacatattcatatatttcgatagtactatgtttggttttcttcccatttcagggatctttttgtcttactataaaattgtcccctccattctaaggatttcatcgtcagatgggaagtataaagccttctccacctgtggctgtcatctagcagttgtttgctggttttatggaacaggcattggcttgtacctgacttcagctgggtcaccaccccccaggaatggtgtggtggcttcagtgatgtacgctgtggtcaccccatgctgaaccttttcatctgcagcctgagaaacagggacatacaaagtgccctgcggaggctgcgcagcagagcagtcgaatatcatgatctgttccatcctttttcttgtgtgggtgagaaagggcaaccacattaaatctctacatctgcaaatcctgcccctcagtcacattctttttgtggcttgatggcttttattcctttccgcatttcctttgtgaatattgctttcttcgttatgcctttatctggaatgagtgacgattctgggatccttggtttagcagaaacctcatgacagaatcttctatacctaggtggcctcttttagtctctgagcaataaccatgccatccaggtggaatcacaaccatcattttatatacacgaagtcctcacttcgttttggaattccctgaaaactgactttatggaaacaatgtacagaaggtcctccaacagcattggttgttcaaagtcgtgtagttatactgttgatgaaaaataagtggtttcactatacataattttgcttcaaggtgaagtttccaagagactttcaaagatgttaagtgaggacatactgtacatcaaattcatatcctcttccacagttcatgtggaatttctttataaacttcttctagagaatctatttaggcaggttctgtgtagatatccatgtcgccgttcctcaatcttggctttgagtcaaatcacctgggcagcttacacatgatgaggactggttctcaatacctgagattctgatttccttgcacctgtgtgagtgtgtggatttttttttttcttttaaagcaccagaggtggttccaatgacgaagtttttagaggcatcaagctgcaatgagtaagaacagaaattaattgtaatatgatttcttcaaatattatcttcaaatgcattgtccatcaacaccatacgaatgtttattatgctgttttttcttaccatttcgcattttctatttccttcttgtcctttttttttttttttttttttttttttttgagtcagagtttcactcttgttgcccaggctggagttcaatggcacggtctcggctcactgcaacctctgcctcccgtattcaagcaattctcctgtctcagccttccaagtagctgggattacaggcatgcgctaccatgcctggctatctttttgttgttgttgttgttgttgtattgttagtagagacaatgtttctccattttggtcaggctggtcttgaactcccgacctcaggtgatccggccgcttccgcctcccaaagtactgggattacacgcatgagggaccgcgcccagccaccacttagcatttacattttgcaattgttgaagttatcgatttatacacacatcaattgctgctttgttatacacttgcagatacataagatgggaaatagaaaagaataaaatgggcacggtatccctgaagtttcacattctgagactttaaaaatatttgctctttagaaatttgtttcaataaagaaactgtggtatacacacccaatgaagtattattcagcctaaagaggaagaaaatcctctccgctgcagacaaaatggatgagattgcaggtctgtatattaaatgaaataagccaggcacagaatgtcaaatatttcatgtcctcacttctacgtaggaagaaaaaaggaaaccttgaccaggcgtggtggctcagacctgtaatcccagcactctgggatgccgagtcgcagggatcacttgagtccaggggttcgagacccgcttggccaacatggtgaaaccccgtctctacggaaaaaacaagcaattagccgggcgtggtgacgcgtgcctctagtctcagctactcggagggctgaggcccaagaagcgcttgaactcgggaggcggagctttcagtgagcccggattgtgcctgtgtactccaacctgggcaacataaagagactccatcacacacctacacacaaaaggaatctcaggaaggtggaaagtataaaggtggttagcagacgctaggaagaaaaggggtgggatggggaatgaagacaagtggataattgggtcccaaaatacagaaagatggaataagtgagttctagtgtttgattgtacagtatgaaaattttagttcacaagaatttcttgaatatttccagatgctttggtaagaaacttcctaattttctcattatgctggtttttcagctcttctctttctgctcttgaaatcatgctggttttttgttttttgttttttgttttgagatggagttttgctcttgttgcccaggctggagtgtcatggtgcaatcttggctcaccgcaacctctgcctcctgggttcaagcgattctcctgtctccacctcccgagtagctgggattacaggcacgcgcctgtagtagagacgggggtttctccctgtcggtcaggctggtcttcaactcctgacatcaggtgatccgcccacctcggcctcccaaagtgctgggattacaggcgtgagcgacgggcccggcccatgctgtaacattatctgttgtctgctgttgtttgtttattttggagcccagaaataacttgtcacctgtatgttcaaacgatttttaacatgagtggtaagaaagctcattggtggaaaaacagccttttcaagaaatggtgttggagaaacttgatttccacatgcagaagaatgaaggtggacactatgtcacaccaggggcaaaaattaacacaaactggatcaaagacctcaccccaagcgctaaaagaatcattcgcctaaaggaaaacattggccatgctttcatgacatcagattgggcaatgttctctgggatatgacaccaaaagcataggcaacaaaagaaaattagattccttggattacatcgaaatgacagacacttttgtgcagcaaaatcacggcaaactgagtgaaaagataacccatggattaggaaaaatattttcaaagcatatatctgaaaagaggctgatatccatcatacataaagaacaggcagaactaaagaacaagaaacccaaagcatcccatcaataatggtcagaagactcaagtagacgtgttcctaaagaagatatagcaatggccaataagcatctaaaatgatgttcaaaatcactcatcatagggaagcgcaaatcaaaccaagaatgtgacaccacacattaggatggatatgataaacaaacaggattggtgagactagagggaagtaggaatgctcgaatctgatcagaaggaatgtaaaaccgtgaaggaacggggaaaatagtatggcgtctactggaaaaattagaaacaggatgatcatatgttgccgcagttgcatttgtgggtacctacaaaaagaagccaggagtggaagacagatttgtgtacacccatattcatagcagcattattcacaagagccaaaatgtggaagcaacccaagggttcgtggacagatgaatgaaaaagcccactgcagttccttcatacaatggaagactattcagccttcaaaaggcaggcacttctggccggtgcggtggctcacgcctgtaatcgcagcgtcttggaagaccgaggtgggcggatcatctgaggtcaggaattcaagaccagcctggccatcttggggaaaccctgtccctactgaaaatgcaaaaaatgagatgagcatggaggcgtgtgcctatagtcccagctactcgggaggatgtggcacaagaatcactggaacccgggaagcggaggtgagcccagattgtgccactgtactccagcctgtgcgacagagtgagactctatggaaacacaaaacaaaacaaagtcaaacgaacaaacaaaaaacaacaaaaaaaaaacagacaggcacttctgaggcaggccgcaacatggatgaaccttgaagacattatcgtcagtgaaataaataaatcccaaaaggataaacaggcccaggctcagtggctcgcacctgtaacaccagcactttgggaggctgagccaggcggatcacttcaggtcaggagttcgagaccagcctggccaatatggtgaaagctcgtctctattaaaaatacaaaaattagcagggtgtggtggcgcacgcctgtaatcccagcctctcgggagactgagacacaagaatcgcttgaacccacgatgtggaggttgcagtgagccgagatcacaccactgcactccagactgggtgagagagaaagactctgtctccaaaacaaaaaaaaaaacacggtatgattccacttatctatcaagtgtctagagtagttaaactcatagagttgcaaactagaaaggtggcccccaggggtgggcgagagaaaggaatggagagcttggtgaatgggtggaatttccattttgaaagataaaactgttcctgagatgatggcggtgatgcttgctaaataatgttaacgtacttaatgtcattaatctgtaaactgaaaaagagtggaaattgtaaatgtttatactggccattctatatgaactaatatatatttataatttttaatatttatacgtggtatattttcccattataaaagatgaaaattaaagcagttggatgtttaaaaagaaaagaaagaagcgaagaatacacaccagctttcttctgattagaggaagagccccaaagtttctatggacactcacttttctcttcttcttgcattattatgaggacatccttagaggctggggaacttgggcggctttggctaatgaggagctctgtgcctgagccccccaggccacaggatagtaaatactcagtctgtgcctccagccctgcagtgtgaggttgcagtcctgtgggctccacagccgtcacctgtatcaggaggctcatgtctcaccctgtcttcttgccagccttgaggacggagcctgagcctccatggtgcaccacgcagggaggacagtggacctgttctccgtggtcatgtcccagcagaggggagaggcagttcagtgagtgtagggaaaagaaagagagatcagactcttactgtgtctatgcagaaaggaaagacataagagactccattttgagaaagacctgtactttcaacaattgctttgctgagatgttgttaatctgtagctttgccccagccactttgacccaacctgaagctcacaaaaacatgtgttgtatgaaatcaaggtttaagggatctagggttatgcaggacttgccttgttaacaagatgtttccaagcagtatactttgtaaaagtcatcgccattctctagtatcaataaaccaggggcacaatacactgtggaaagccgcagggagccctgcccttgaaagcagggtattgtccaaggtttctccccatgtgatagtctgaaatatggcctggtgggatgagaaagacctgaccatcccccagcccgccccccgtaaagggtctgtgctgaggtggattagtcaaagaggaaagcctcttgcagttgagagagaggaaggccgctgtttcctgcctgcccctgggaactgaatgtctcggtataaaacccgattgtacatttgttcaattctgagatgggagaaaaaccgccctatggtaagaggcgagacatgtttgcagcaatgctgccttgttattctttactccactgagatgtttgggtggagagaaacataaatctggcttacgtacacatccagtcatagtacctttccttgaaattccttatgaaatagattctatttctcacatgttcgttgctgaccttctccttattatcaccctgcgctcctactacattcctttttgctaaaataataaaaataatagtcaataaaaactgagggaactcagagtcctgtgccggtgcaggtccttggtatgctgagcggcggtcccctaggcccactgttgtttctccatactttgtctctgtatcttatttcttttctcagtctctcgtcctacccgactggaaatacccacagctgtggaggaggaggccaccccttcaagtgagtgctgagggacggtcgggagacttgtttgtttcctcatcctcaggacaaacaggagagtgcggtgggcagatgtgaggagaccaatgtgcaactctctgctcagcagactgtgcagtttatgttcttggttgtgctgggggtctcagaaatcttattcaaaattttgctttcctcccccactggttgtccttttcataaacatctcacccatgatagcagggaatcagtccctctaactattccctaagaacaacaaagagattatgaaggtgatgatgaggataaagaggatgacgacagacaccatggcatcatgaacccttactgagggcttcctaaaggccaggctctgagctctgtgctctatgcagcttgtttcatttcatctgcatagtctccacgttattagtgcacatttcatgatgattttacagactagaaaaagcgcaacggattttcatgcagcttgtaccagatcacgaagtcaaaaagggcgaagtccaatttgaaccaggcagtctaagtccagacacatggcatttggcaagtcctctccctgcaaccaacctgccctctcaaatcctcgtcactcaggcggatgcccctactcactgtgcccttccctttgtgggttccttgttgaccacagctagaccagtgggtgccacaatcactgtgtcatgtatagaaagggcagctgagatcacatcaaggattccagaaagaatttgcacaggatcattcgggacgcatctctcccttgcccctgttcctggctttccttacagctctcaacttcctcaaaggagtcatcaattcggagtttggcttccattcctattgaggaagctggaaagtgtttcaaaaatgctcctccgatgtgcctgtggttaagacctctgagctctgcttaaaactctttgaagctgggcgcgttggctcaagtgtgtaatcccagccctttgggaggctgaggcaggcgaatcacaaggtcaggatttcgagaccagcctggccaacatggtgaaaccctgtttctactaaaaataccaaaaaaactcaaaaaaattagccaggcatggtggcatacgcctgtcatcccagctactggggaggctgagacaggagactcctttgaagccgggagacagaggttgcagtgaatcgagatcacgccactgcactcctgcctgggcaacagagcaagactccgtctcaaaaaaataaataaataaaaattacgaaaaaatggcaaactttagccgttagctcacgtaccactttggaagggcatacctttagtcacttcaccctttaatccctttgctcaagactaaagttctgagaggaagactaatcggctgagttgtgtccatgtgggcagtgcaggaaaggatgcagcgggacgctgctccagggatgtctttggcttccatcatgggggagcaggcgcctggattacccaccctaacaaatctggacaaaggaaaacgaggttctccgaggaaggagacatagagcccaaggagctaaccaagagacaaatggtcatcctgtcttgtcattttcttttacacatgtgtgtacattatcttacacttatcactttgttttctttctctcctttaattgcacgctgctgccaaaagttaaaataaaatgaaagtattgagatagctcagtaactgacttttggtcaattgccttttcatatagtgaacaggtgcccaaacgattgtctctgtcactgtgcaaatttgcaagcgtttgcatgatcactcccactcccccaatacagagctgtgttacagcacaatttagttcagtgttttgctctctgcaacagggaggttctcatccattacacgttgcagtaaaaacaggggtaccataagcaaccagctctttcctcaaagaggtgatgaaagcaaaagccaagtagctccatgtatccaacttaaaaatataaaagttacgcccgtgggctgcagttggagctatggcggcggcagctgtcactgggcctagcccggggtgtggacctggggactccccagaagggcccgagggggaggctcaaggagcgtcggtggaaggcggacaggatgctgaagttttacaacggcctctcggaagtggaggcggtgggactccctgcggggaccgaccccctggaccccactgatatgaacggggtacacttcgacccggaagtttacctagacaagcttcctagagagtgccctctggcccagctgatggatagtgagacggacatggtgcagcagatccgggctctagacagcaacatgcaaaccctggtctatgagaactacgataagttctcatagacccagccacagaaattgacacacagcataaaactgtaagaggaattgcaggagacccagaatttcccaaataaccttgtaaaagaagaacaaatttggaagactcacaaaaaatatatatatatatatatatatatatatatatatatatacatattatatatatatacatatatatataaagttgtgttttcattcagttgtaaatgtttagtaatttctattgtgatttttcatttaactcatgaaaggatatttttaattttccaaatatatgcttgtgtttagctatcttcttgctgttgacttctaattttgtggcattatggtcaggaaaatgtggtctggacactgtcaatcgtatagtggattttgttgagacttctttatggcctaatatgtggccagtttttttttttttttttttttttttgcaaatttgccacatgtggttaaaaggaatgtggattttttttttaggagagtttttattttgaaatagataaggttctcagtgtaattgaaatctaacttcagttaacaatatgctagacctctcaaacctcaggatgttagtcagtgtaacaatagactgctgctgagacgaataaaccctgaactctcagtgggttgacacccatagcatagtctggtgcagggcaggggttctccttgggggcccttgtccaacagtgattcagagattctggaggtttccatcttttaattctgccatctcagagtttttcacttgtagccatatggataggaagagagggaacatagctcacactttgataaccttggcccagaagtgatttcttacattcctattggtggaaatgcagtcacatggttccaaactaactgcaaatgaggctgggaaatgtagtctttctgcatgtccaggaagaggaatggtgtgaacacagtattgtctttgacacactaagcatgtgctgaagagttcttactctcataggaggtttgtctgtcctgtgtaactttctcagtttttgcttagatagtttcaggcaatgctgtttggtgcattcagcttgatgattattatgtcctcttggcaaagtagtcaagattcccatcagtttgaatgaaagtgttttacagataggtcaggaaatgttaatactttaaaaggcccttctattcctccactctacatataagaaaaacagagtcctagagagaggaggtcatgggtctcactcatgagtggcagaattgaaaccaatgtggcactaactttgcctttcccccatcatgttgttctccttctatcttcactctgctgatttcttcacttgctccatacagacctcccagtgccaagtgtataagtgtgtccagaattggtgggttcttggtctcactgacttcaagaacgaagctgtggaccctcctggtgagtgttacagttcttaaaggtggcgtgtctggagtttgttccttctgatgttcggatgtgtttgaagtttcttccttcaggtggggctcgtggtctcgctggctcaggagtgaagctgcagatcttcacggtgagtgttacagctcttacggctgcaggtctggagttgttcatttctcccagtgggttcatggtcttgctggcttcaggagagaagctgcagaccttctcggtgagtgttacagctcataaagtcagtgtggacccaaagagtgagcagcaacaagatttattgcaaagagcaaaagaacaaagcttccacagtgtggaaggggaccccagtgggttgccactgctggctcgggcagcctgcttttattctcttacctggccccacccacatcctgctgattggtccattttacagagagcctgagtggtctgttttgacagggcactgattggtgcgtttacaatccctgagctagacacaaatgctccccacgtccccactagattagctagatacagagtgtccacacaaaggttctccaagtccccaccctagtagctagatacagagtgtcaattggtgcattcataaaccctgagctagatacagggtgctgattagtgtgtttacaaaccttgagctagatacagagtgccaattggtgtatttccaatcccttacctagacataaagttctacaagtccccaccagactcaggagcccagctggcttcacccagtggacccagcacaggagctgcaggtggagctgcctgccagtccctctccatgcacccacactcctcagcccttgggtggtcgatgggactgggcgccatggagcagggggcggtgctcatcggggaggcttgggccgtacaggagcccacagaggggggaggctaaggaatggcaggctgcaggtcccgagccctgccccgcagggaggcagctaaggcccggtgagaagtcgagcacagcagctgctggcccaggtgctaagcccctcacagccccggccggcaaggccagccggcagctcctagtgcagggccaccaagcccacgcccatccagaactccagccggcaggcaagcagcacacgtagccccagttccagctcatgcctctccctccatgcctccctgcaagctgagggagccagctctgacctcggccagcccagaaaggggctcccaccatgcagccgtgggctgaagggctcctcaagtgctgccaaagtgggagcccaggcagaggaggtgccgagagtgaacgagggctgtgagggctgccaacacgctgttacctctcataaggagtgattaatctgagcttctccagaaagtccattcctggtaggcactgggaataagaaatctcagagtataaaaaaacatcaagtggtagcacttttgtgagtggctcccaaattagatcctttacctttttttcatgaagcacagttgcccaaaacacgcttagcctgaggtgaagcacatattagagaaaagttctctctatagcattatgtattactcaaatgagcattaaaaagaggagacgggatatgctctctctagctattattacctgcactatagagttgacatacacaagctcattattgcattatgttttattcaacaaaataactttaatgttgaagcttaaattgaattcgctaaaacatctttgtctccagcatagtgtgcctcaagtgtctccttggtgcctgaattttctccagaattatagtgctgaaactatggaaatggtgaaattatatgcaatctgcaaaacaatgtggctataacgtggtaattggccttccacataattaaaggaacatttcctcatcagagctgttccatcagagacccaaaggctatcgttgtacaaatcacccacttaggaaaacctttattcccagtagcctataaaaatctgcttatgcaaacagatttgcttattcagtaacattaatggcttctcataattaaaaagtcatcaatgtgattgacctataatctgcttcctctgtgaccaagtgtcatttttattttgacagttaggagccttttgactctttcacagctggcatgaaggcacagggagggaaatctcaaaaaccaacaacctgtgtattcccagcctattaatcaatagaaaatcacttcaactggattagggtcttgtacctggcagaaaggctcttatggacattggaattggatttttacacttgatatgacacctccttgagtcagatcagattcgtgtttgatagactcttgccgaaaaattgctccagggtctgtgcagtagctaaagcctttttattgttgttgttttaaaagcagcattaaatgttttcatgaagaccttcccagcagttattttattgggaatatggtctttagctctggtcctgaataactcacactgaggaaacctctaacaagtgttttattggaagatgtctgatggatggttggttttaataacaaatctcttccctttttctgtcccctgtgttctatgctcctttcttacacattattctgggaggattcacctattcccaaagtcctttcctctttatttccattccagagctctctgtataactccaggctgatgaatccaactgcccagttgttatctccacttggctgtctgtcttgcattgacctcatcttacctttcctctcctgatttcctcttctgccagggctcaccacgtcagattcacaccaccatccacccagcttccaaatcacctgggcctcctccttcattcctccctctttctcagtcaagttagtctactgtctcctctccatcctcactgccacagccttggtccagccaaccatcttgtctcacttggcgtattgcagcctcctacctggtctactcaccacccactctcctccagccagactgctcttcttctagcacaaagtggatcattactcccctgcataaaaacatctactgtctccctttctctacaggatagacacgacaaagagcctttaagatttgcctccaacttacctctatattactcactttttacaattatatgaacatctctcagctcctcaccctctcacgtctcgatttttacacatgctcttccctctgctgagaatgatcttccacacctctcctatcgacctggctagttcctaccattttctagtcttcaactgaggagtcctgtggtggagaaggatttctcaccacccgatatagattgcatgcccacccacctccgagctttttcttttttctttctttttttttttttttgaaagagtctcgctctgaccatgcaagctggaatgcagtggtgcgatcttggctcactgcaatctccaccacccgggttcaagcaattctcccacctcagccttctgagtatctggaattacaggtgccccccaccacatctggctaatttttttgtatttttagtaaagataggatttcaccatgttggccaggctgttttcgaactcctggcctcaagtgatccacccaccttggcctcccgaagtgctgggaatacaggcatgaacaactgcacctggccgattgggtgccccttctatgtgctcccattgccccaggcatactgtcaccataactcttaccattctgagttgaaaatgatttttttttttgctttttatttctctcattaaatgaaagcttattgaaaagaggacagtggttgttcactgttgtactcctaacctttgactcagtgtccttaggttggctctacagctgtgcacacatgttcagacattggagcacatcttgtctagcacctcttttgtggtggcttagagaaaagtcagtaggtacttccccaaggatgaaacagaagcttcacctaaagcagttcttcaacttcagcctgcattagaatcctctgagaccttgttaaaaataccatctcctggagcccactcttcaagagtcggtgagttgcttcatcatcaaaatatacacagaattcaggcagtcttcagccccagcctggtctgaacctctgtggactcccacctgcagaatgtccctgctggtctccttgcttctgctcttaccttcttattacccattcgagtagccggggtgatcctttttaaaaaattttttaaatttttttgtgatgaagtctcactctgttgcccaggctggagtgcagtggtgctatctcagcttgctgcagctctatctcctgggctcaagcaatcctcccacctcagtctcttgggtaactgggaccacagacatacaccaccacacccggctaatttttgtattttttgtaaagacacggtcttgctgtgttgcccaggctagtcttgaacttctgtgtgcacccacctcagcctcctgcatttttaggaggctcctcttgtagggattttgatccagatgcctgggtgcctcatgtctcctcccatctctctctgtctttctgtctctgtctctctctctctttctctttgccttatagctgccctggggtctagactctgccttaggcatccctctggctcttgtttgcttttatactgaggctgctttaaattgcaccttgatctgaagccttgggcttctgtttctattccttgcttttgttggaagggccatgcagcttcttgacaaattgcaaaggtgcccacgagtttccaagtccccaagaaccaaaccagatgacaaacaaggatgcagtccacagctggggagacagatttcatgtccacacagagactccaagatgctgaactgaaatccacctcgaaacctgttttctctctcatttaagttcattgtcacctgggggcttgcagggcagagctggtgaccattctcagggcaaagatgctttgaaatgtcaactgagaatggtgtggtggttgacagatggcacgtcagagcatagattaacatggaaagagaaattcaccccttggggggagtgtgtgaggctggcagccacacagagggcttttcctgtgagctcttgcatagatgcaaacagccaggaggttttgctttctgatcctaagtggaagcatgttcttccctgcacattgccgctctgcagcaaatgtttattcctgttgcattgattaaaagtgcttaccaggccgggcgcggtggctcacgcctgtaatcccagcactttgggaggccgaggcaggcagatcacaaggtcaggagattgagaccatcctggataacacggtgaaaccccgtctctactaaaaatacaaaaaattagccgggcatggtggcgggcacctgtagtcccagctacttgggaggctgaggcaggagaatggcatgaacccaggaggcggggcttgcagtgagccgagattgtgccactgcactccagcctggatgacagagcaagactccgtctcaaaaatacaaagtgcttaccgaagtggtttgagggcagcggtgacactgtgagttatggctctgccggcagccagtggagccagcctctctgcacagctgtgcaagggtgttttgaaaagtggctcagccggccaggagtgactggctgtaaatattgctgccagaacatcttgtagcctgattggggccgtgtttgcagaacccctaaaccactacacttgttcaggcttaaaaataagcttacttttttttgtttgttttgttttgttttatgagatggagtctaattctgtcaccgggttggaatgcagtggcatgatctcggcccactgcaacctctgcctcctgcgttcaagtgattctcctgcctcaggctcccgagtagctgggactataggcgtgtgccatcatggccagctaatttttgaatttttagtacagacggggcttcacctttttggtcaggatggtgcgatctcttgacctcgtgatctgcccgccttggcttcccaaagtgctaggattacaggcgtgagccaccgtgcctggtcaaacataaacttactttcttacctcttctgctgaactctatgtgcttcttttcgcaacttctgctgaactctattttgcttctttttcctggataaggctcttgtttatccagaagaacttttagcaacaaagttacccaatgcctttccctagtctctccttgcaactgactctcagtggtgggggggggtgggtaggaggaaatccttgacagaaccaatttacatgactgtttggaggactctcactagccccaggaggtgtttacatttttaaattggttactagtgtcagaatgtttcatgagtaagagcacagcctctaagttggataccctgaatttaagtctcaacatggccattttgtatataagcagaggacggatttggggacccaatggatctaccatgacatgaacttggaccaacattcacctgaactccaaaatgcctattctgactggtagaccctagtctcgccctagtgccagttcagagcctgtgtccagtggtcttgcacaggtcccattagttctttttctcctattcagtcatcctggtaaaggctgtgtattcccttggggacaggctgggagaaagattgacagtataaatttttggcagtggagcagagtcctttctggaggggacctggcttcccattcagacaagggactccaggtctgtgaactggcttatgtctgggaattgacgggggactgtgactctgtttttatgattcagattagacttctgctcacctgacctagaattcttcttcaaacacagatcaagtaaaaatgtggcaggcttcttatctatttcagttctaggaaagccacgatcagccggcaccataggtctctgcgagtcaggctattctggttgcagctttgactctgctgtcttttatggtaactgcatccaccttgcctttggggattgagtgctctgatcacttgaccccagcccctgtactgtgcgtatgtcacttaccctctttatacctcagtctcctcctctataaaatgggcatcctcattgcacccacccccagggctgctgtgaggtatagatggattagcatatggaaggtaatagaagagggtctcaaagcccatgtgtcgttatcagaattatttcgtgacaggggagagctggaggagagaggaaggtgctgagcagacccacgtgctctcccaccagtgtttcctgagcacccactatgtgctgcccactgtgagagctgttagggttgaaatagggagaacagcaggataggggttgccatcaggagcttagtggggagaccgttgtgcaacatggttacagtgcttgggggtggggaagcccagggactacaggggcctaggatccagggcagaatcatggaaaggacacagccgccccagcctcccctgcctcccctgcctccctgacctcctctgttccctggcctctcctgccttcctggcttccccttccaccccggcctccccagtctcccctgtctttcctgcttttgaggtgggccaggagctgctggtgctcacttagcctgtcctggactctgggtgtagcacttcggtgtccagaaaatacccccgggttcagcttatcacacagccaagaaaggagctccacactgacactaagggtgcatcctgggctcattcatcagggcatgcctccaaaatatttctccacgtctcctccctttgcccacctgcattgtctctgtgcctcagccccagctgggggcctgcaaggatcctctatctcctctgcccctgcacggctgggtcccaggcaatctgtctgcccaccacacctctctcctgttgcccaccacgctccagccccacagtcctctttctgcttctttcccagcctctgggcttttgcacacgctgttccttctgcctgaacaccctccactgggctgagaacaactctctgagacctctctcagctgttgcttcctttggaaaagccgctgctgctgtccctctcccagctccaagacctgctgagcctcctgtctttttcagttcccatgcccccagcacttctccttggcctcctttggcccaactgacaatgtccattctcaatgccttcccacccagcgctgagccccacttggtgaaggcaatgcctgtcatgttcaccacaatatcccctcccccatcaccacgactggtccacagtgatgctcaaaaaagatctgttggtaggcaatgggaaggtgcattcatgtcatcctgcaggcggaattctccacgagttttgagcagcctcgggtttcccaccacctccaaatcatggaagacacacggtaagagcaaagacaaggtggctgtggccgatgtccaccctctcgtggcgtcccttctcttctctcctccttgggcagggagaccatcggggtgcaacctggctggggcggggaggtggtgcagggcattgccagagcgggcctgtccatgggcaagggacagcgacctcctgggccaggacatgtgacagctgcgcaggcctgggcccggcgtggcagaggtgcgcgagagcggccagaagagggcgccagagagccaggcgcggcccgcggaggagcccgggccggccccgatacccagctccgcgccgcgcggacccaccgagcccgtgctcagacgccccagctccgccgagaagccgcttgagccgggtccttcttcttccccaagttcaggcagagcccgcggagccatggccagcccttccagcagctccgaagccactggcaagccccgaggcagggatggcagtcccaggatgggggaggaggacgtccctcccgaagagaagaggctggggctgtagctggaggggggaagcgcacagcccgaggactgcgaggacggggaggacccgccgctgccaggcaggaaggagaccggcacccagacaggtggcgacggcaaaggagtaagtgatgcgggcgcgggggtccgggagtgccgggggctcgggggtgccggggacgcgacgaaggggcgtcgggaggctccgtggccgtccccgggttgaagttgggagtgcagccttcattctgaacccatttaggcagcatgggcagccctcctcgccatgggcaggatcagagcccccccgcccagtcttggggttgctcctggatgctgtctgggaggcttgctcatggtgacatcctcatctccccgtccacgttaccgcattcagagcttgggtcacctggacactgaactcaggtgaattttctctgagatcccgggagaaggaggacagttctttggaaggttttccagggccgatcacggaaaggatgagaagggagaggtcctggtcggggacacaattatggtgtcagtgtaacgccgggaaactttattgcatgaagtccctctcactccctctacctccctcttttacgtggactctgccaaagaccaggataccagaatgcggtggagaggccaagtgtagtgagaccttgggaatgcgattctggagccaggcggctggggtttgcatcctggttctgcccctccttagctggctgacatggcacaagccacttaccctgtctgagccttactgtcttcagtggcaaatggatctgtcaacaggctccattgcctggggttgttgctgctgagattaagggaagctcgtccatagaagcacttagcgttgtgcctggcacatagtgtatggtggataagtgggacttaagactaaaactcatgccctgatgtgtttttgcagtgatgttttgttctggagtacgtcacaagagacaaggttcttggctgggcatggtggctgaagccaataatcccagcactttgagaggccgaagggggaggatcgcttgagcccaggagtttaagaccagcctgagcaacatggtgaagcctcatatctcccaaaaaaaaaaaaaaaaaaaaaaggcagttatggtggtgagtgcctgcagtctcaagtacttgggaggctgaggtgggaggattgctagagcctagaaggtcaggctgcagtgagctgtgatcatgccactgcactccagcctgggtgacaaagtgagaccgtttcaaggaaaagagagagagacagacccacaaaagtcttaagccagaatctccatgttaaaatgctttctggaggctaaaaggatgatatgttgataatgaaatgtttaaaaggcagaaaccccactgaattgtttggtccacagagggaaatgggaatcgcatgacctgaaggatgatggaggaactgaacagaaaccatccttgtttcctgaatctgaacatggcacgctcttttcacggtgcctgtatctgctcagtccggcagccccttgaaaagagggaatcttgattttcaaacttaaaatttggcccaaagctcactgctgcccacaatgcccgccagacacattcctcttcccttttagttcctatgggaatactctctttgaagaacccatgaagcagtgtcaggctggtacgaggatcagcagtgatttctttgaggaggagagcccgtttcttcactcacaggccatgtctgagtggatcaagaagaacagagtgcccttttatgagattttgtctgcgtagaccactagcttggtaaaaatgtcaaaaccatcctcgttctttaataacagattattttggacttttctctgcaagaagcagcatgggcattcagatgcttttaaggataaaatgttctttctcatcaccaggactggtgctctggatggctgaggttttaatgtgactggatgtcccttggagtggctcccaggctgtgctcttgtggttgggtggcaagcggttgctttattcggtggtggctagaggatgttttagcagattaatcgggaccccaggagcccctgagtgtcaagtcctgctgcagggcatgtgtttatggtggggaggtgggggagggtggaggggggggcattgatttcctcccaatatcagaagtttcacaggcttcttgtttatccacaaacacccaccccattgagaaggcctagaaaatctgcccctcctcaagcctttattgaccgcttgtgaatgatcccagtgtgtgtctgacccacagctcctcctggagggagagaaaagtctctcctaggtatttggttgtccacctcaaccacttgctgagtcttccgcaagaccaggcacctcggcagagatttctgggttgtcaggcagaaccgagcattcaagggtgataactcactggagtccctgaaatccctgatggacgcaccaggtaaaagcatccagggttgaaaccagatcaggaaggttattgtcagcctggggctcctgtagaggtgcatccacgttgcagggattttccttcttgctgaggagaaacctgggtttctcagctttggcacagtcagaatatttgtggtgagaccattcgtggtgctggtggtggggctgtcctgtgtattgaaggatggttagcagcatctgtggtctccatcctctaggtgccattctaccctccctgctatggctaccccagacgtctccagatggtttcaaataatgtggggcaagggagcggtacgtgagcaaaaccaccccagttgagagccattggtccacacttgtataaatgtttgagggtgagagtgtcgagcttgggtccctgctgtaccctttatgagcaatgcggtcttggaaaattaatactactccaggggcctcagttttctcatctataaaatggagataaatgagatacactttcataggaaggttatatgggattcaccgagataataagacagtacatggaaaatgctgcgcatagcatttatttattttaatttttttttaagacagagtcttactctgttgcccaggttggagtgcagtggcatgatctccgctcactgcaatctccacctcctgggttcaagtgattctcctgcctcaggctaccgagtaactgggactacaggcgcgcgccatcatgcccatctaatttttgaatttttagtagagacggggcttcaccatgttggccaggatagtccgatctcttgacctcgtgatctgcccgcctcggccttctcaagtgctgggattacaggcgtgagccaccgtgcctggccaaacataaacttactttcttacctcttctgctgaactctatttgcttcttttcccatacgtctttatccagaagagcttttagcaacaaagttacccaatgcccttccctagtctctccttacaactggctctcagcagggggtgggaggaaattcttgacagaaccaatttacatgactgttttggggacccattctagtcccaggaggtgtttacacttttaaattggttactagtgtcagaatgtttcatgagtaagagcccaggctctatgtcggatgccctgaatttgaatctcagcattgccgctttgtatataaccagaggatggatttggggacccaatggacctaccgtgacatgaacttgcaccaacattcacctgacctccaaaatgcctattctgactggtagaacctagtctcgccctagtgccagttcagagcctgtgtccagtgatcctgcacaggtctcattagttccttttctcctgttcagtcatcctggcgaaaggctgtgtattcccttgggggcaggttgggagaaagactgacagtataaatttttggcagtggagcagagtcctttctggaggggacctggcttctcattcagacaagggactccaggtctgtgaactggcttatgtctggaaattgactggggactgtgactctgtttttatgattcagattagacttctgctcacttgacctagagcacttctgcaaacacagatcaagtgaaatgtggcaggcttcttatctatttcacttctaggaaagccacgatcagcaggcaccataggtcgctgggagtcaggctattctggttgcagctttgactctgctgtcttttatgataactgcatctaccttgcctttggggattgagtgctctgatcacttggccccagcccctgtagtgtgcgtatgtcacttaccctctttatacctcagtctcctcctctataaaatgggcatcctcattgcaccctcccccagggctgctgtgaggtatagatgcattagcatatggaaagtaatagaagagggtctcaaagtccatgtgtcgttatcagaattatttcatgatggggagagctggaggagagaggaaggtgctgagcagacccacgtgctctcccaccagtgtttcctgagcacctactatgtgctgcccactgtgagagctgttagggttgaaatagggagcacagcagggtaggggctgccatcaggagcttagtggggagaccattgtgcaacctggttccagcgcttggggtggggaagctcagggagttcaggggcctaggatccagggcagaatcatggaaaggacataacctccccagcctctcctgcctccattgcctccctggcctcctctgcttccctggcctctcctaccttcctggcttccccttccaccccggcctccccagtctcccctgtctctcctgcttttgaggtgggccaggagctgctagtgctcacttagcctgtcctgggctcttggtgtagcacctcaatgtccagaaaatacccccgagttcaactcatcacacagtcaaggaaggagctccacactgacactaagggtgcatcctgggctcattcatcagggcatgcctccaaaatatttctccacgtctcctccctttgcccacctgcattgtctctgtgcctgagccccggctgggggcctgcaaggatcccctatctcctctgcccctgcacagctgggtcccagtcaatctgtctgcccaccacaccttcctccccttgcccaccatgctccagccccacagtcctctttctgcttctttcccagcctctgggcttttgcacacgctgttccctctgcctgaacaccctccactgggctgagaacaactctccgagacctctctcagctgttgcttcctttggaacagccgctgctgctgtcactttcccagctccaagacctgctgagcctcctgtctttttcagttcccatgcccccagcacttctccttggcctcctttggcccaattgacaatgtccattctcaatgccttcccacccagcgctgagccccacttggtgaaggcaatgcctgtcatgttctccacaatatcccctcccccatcaccacacctggtccacagtgatgctcaaaaaaggtctgttggtaggcaatgggaaggtgcattcatgtcatcctgcaggcggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagccaggcgtggtggctcatgcctgtaatcccagcactttgggggccgaggtggatcacctgaggtcaggagttcaagaccaacctggccaacatggtgaaactccctctctactaaaaatacaaaaaaaaaaaaaaaaaatagctgggtgtggttgtgggtgcctgcagtcccagctactcaggaggctgaggcaggagaatcgcttgaaccaaggaggcagagactgcagtgaactgagattgcaccattgcactccagcctgggcaacaaaagtgaatctccgtctcaaaaaagaaaaaaaaaaaaatgacaccgaatttgctaaagggggagaaagggctttcttccaaagctgggcctggtttctacagagagtctttcacatgaaaattaggcagctctttgcaagcacctcagaggagaacccctcaccctgatgaatcaggcacaggggcagatccaagacaactggctgcgtgcatatgaacaagtctatggtggaaatgcagtgctttatttgtttgtggtggtttaatcaccaggagggagaagcttctaaagcagcattcagaggtggctgttgcctgggttttctggaagggggaggcggtgaggatgagggcttccctttcatctgcaggccccttgcagaaggagctggggaaagctttgcaaccctctgcacactgtttgccatcttgtctggctgggacgccgagctccagatgggggcagatgggatagctcttgccaccgtatttggagagagatggcagggaagtcagcccccgtggagaagacaggagcaggcacgtgctggacagtgctgcccaggcccctggggctgaagtgtccaaccccacagcctctaggtgccactaaagcagcccaagaggaccttctctgtccatctccatcctggcacctacagacacttggagagagtccttcacatgggaactcacaaatgcacactgataacccccacacggaactctcatacgtagcaagtgaaaagacaggatgccagcttaacttgaatttcagataaacaacaaatcattttttagggtaagcaggtcccaaatattacatgggatatatttgcaccaaaaaaaaaaaaaaaaaaaaaaaaggttaatgagaagttcaggtttaattggacctcctgtattttacctggcaagcctaaccctgcataaacacaacctcgagcttgaaactcacagagaagccacggccgtgctcacacacgtgcacaaacccatatgccttacagagtcaagggctgtgatgagggtccccacccttgcacacttctctgtcctctgtctgggctcagagtaaacagggggtcacctggaatccacgtctaagctgggcttggaggtgtcctaatgaagcaggatgctgacatgcacttccccaggtcagctgggactgtagccaggcctagcttccagtctcgggcctagaacacacagcacagccccagaccttggcaagaaggcttcatctcaagggccactggtgcaggaactattagaagccccacttctttcctctgtttctgctgccattgccccagtctctgaccctgccactcaatcactctataaacacagcaggtactaggggtggctctgggctcagcactaaagacactgaccctggtaaagccacagtctagcaatgacagtcaaccacgtatcagcaacagccctgccccacacgtgctgactgcgcacaaggccggcgctgtgaacgtgctctcaacagtgatctcactgaaccctcatggcagctctaggatgcagacagtagcatcacattatccccattttacttttgaggaaactgaggcctgaagaaggcaaatgcaggcctcgagatttgcagtaacattgccaggaatgtttgagaaagcaaacttctccagagtgaggcagtctgccagagctcagaagccagagtccctgttagcaggggctgggggcactgtggggtgagggcagacaagtgggtaggggctggaacccccaggacaccagggtgcagactggtgtgagtaaaagaaagaggggctgtcatgccatcatctgcagaagatgatgtctacagaggacagtaccatgtgagcccttggggaggtggatgactggatggaattttgcacaggatgcaaattgagcacagatccccctctgacctagacagcccacttccaggaacatctcacagaaatgcaggcacagagcaccaagtgatgtgtgtaaggaaattcatcagaacaccgtctgtgactgggaaaaggcggaaaccatccaaagacgtatcggtgcagggctggttaaacgaagcgtggtgcatccacaggtcagaataactgctgggagaagaaggtggtacccaggttccaacgtgagacaatgtcaaagacatgctgcctgaaaagcaggctttccaaagaataaatatagcattatttcatttttacttttttaaaaatattacaataaacacttatgtgcaaatacatgtgcttgtgtgcacagaggaaaaagctgtggacagaaacagaaaaccaaacacggtgtgctctcactcataagtgggagttgaacaatgagaacacatggacacagggaggggaacatcacacaccggggcccatcgggggtgggggacaaggcgagggagagcgttaggacaaatacctaatgcatgtggggcttaaaacctagttgacgggttgatagatgcagcaaaccaccatggcacatgtatatctatgtaacaaacctgcacattctgcacatgtatctcagaacgtagaataaaaaataaaaagaaatcaaagaaaaaggtggggagaggtataacccaacccttcccagtgttacctctgagatgcaagaacaagaaaagcaaatcaagaggtagttttgctttctgttttctatataaattttttttttttttttttttttttctggagacatagtctcgctctattgcccagtctggagtccagggacacaatctcggctcactgcaacctcctcctcaccacaacctcctcctcactacaacctcctcctcagtgcaacctcctcctcactgcgacctcctcctcactgcgacctcctcctcactgcgacctcctcctcactgcaacctcctactcattgcaacctgctcctcactacaacctcctcctcactgcaacctcctcctcactgcaacctgctcctcactacaacctcctcctcactgcaacctcctccttactgcgacctcctcctcactgcaacctcctccttactgcgacctcctcctcactgcaacctcctcctcactgcaacctgctcttcactacaacctcctcctcactgcaacctcctcctcattgcaacctgctcctcactgcaacctgctccttctgggttcaagggattctcttgcctcagcctcccaaataactaggattacaggcatgcaccaccaagcccgactaacttttgtattttttgtagatacagggtttcactattttggccacctggtctcaaactcctggcctgcccaccttagcctccaaaagtcctgggattacaggtgtgagccaccacgtctggcctgcattgcttgaattctcagaccacatggaccctctcatctggtccaattgcaagagtccaaggcaggaaaggcagaaggcaggggcttacccctccatcaggacaacatagaacagagtcaaaaaaggaaaacatgaatggatcagtcaagagggccgtgcacatgccctcccaggcacctacatcttgcaacttaagccgacagcctttcaagccacagagtcttcctccccagagactagcaaggacacaagccctggccaggcccttccaggaagatgttctgagggacaaggtggggggcacagtcaggggtggcaggaggaaagggggacacgaagccaaggaaaccagggcaccccatgcttcctgaaggcaactagaacagggcgccacacagagcccctgtgtacctgtttctacaacagcctgaatacaaggaaaaggaaaacaaggaaaatacacaaagcccagcctcaccaggagcaggttaaataaaggtgtgtgaattttcctcatgtcctttggaattggaaatccaagcttcctcttctgtgcctttaaggtcctggccgctgccgcacagctcccttctcttccctcctcctcctgtcctatttttttttttttttttttttgagatggaatcttgctctgttgcccaggctggagtacagtggcacaatctcagctcactacaacctccaccttccgggttcaagcaattctcgtggctcagcttcccgagtagctgggattataggtgtcaccatgtctggctaattattgtatttttagtagagacaggttttcaccatattggccagtctggtctcaaactcctggcctcaggtgatccgcccacctcggcctcccaaagtgctgggattacagatgtgagccaccatgcccgaccctcttgtactaactctgccatctctttgcagtctcccctgagcagcttttcctgggcccgcactgcccccctccagagctgcactctcaaaccacgccccaatgccccctggccctggctcctgccccggggctctgatcctcagctggtgaggtctagagtgtcagagggagccagactccttagagaagctaaggcgggagacctgtgctgggctgtggttaaactgctcccttccagctggggccgaatagaaagtgaaagactgcccccagaatacagggccctcagaggccctggggatctgtgctggcagtcaggaggactgtcacctcagtgcagttgcctgcaaggagggctgtgcaggaagctgcatgttgctcagagaacaaaaaaaggaaattaaatgcaccatctccttattagcatgagcttttgaggcagacacttaaatatgcatgcctagacattgtaaaacttgggggaaatgttaatttcaataacgccacttcttgtgcttgcagaaaccattcttttatctcccttcctagtcatttgtgggctccatccctcagagtggcagcgccaagacagccggcctcactgggttttctaagctgtgcaaggtgagatcccaagccctggcctcgagacccatcttaggaaaatgttagaacagggcaacaagttgccatttcctccctcctttctcttccccatacaaaaatcagaaagcacccttgcccagtgcccagccacagtgaggaagaaaccccacacaaaatcctgggttgtgcccctgataccaaagacctgcaaaattgggcctcacctgctgcaacctcagcccagacttgtgtacatttcaagggtggctggactcatggccgcctgggacgtcagagtggtacgaagtcctcttaacctaagactgtcggggtacaaggatcagcatttttttcctttctctccagggccagatggtaaatagttcagctttgcaggccataggtctctgtcccaactattcaactctccactctccattgtagcaggaaagcagccacagacaataggcactgaaatgggtgtggctgtgttccaataaaactttatttgtgtgaacaggcagggggctggttctggcctgtgggctatagcctgcctcctctgctacagggtgatctccaaggacccatccatcttgtagaccagcagctggcacacaggagctgctcagatacttgaaggaggaatggagaaggcaaacagcccccagtgtgcagatgtgagggtctcccagcggcaccatcctttgccatctcatgccaagggacaaagccagagcagggctctccaccaaggctgggttctcctccaaggaaatgtgataacaggacagaaagcatcgtggaaggataggggctttggagtcccacaaaccacagtttgcaagaccaggagcatcctgcacttccttgcacacatcctgcgtgggtactggagcatctagacttagagtgaatcttctccccatcctcccccaactggcctccattaaacttccagcaacaatgtggtgtatgtacacaatggaatactattcagccttcaaaaagaaggaaatcctgccatttgagacaacatggatgagcctggaggatattatgttaagtgaaataagccaggcacagaacgacaaataccacatgatctcacttacatgtggaatctaaaaaagttgaactcggccaggcatggtggctcacgcctgtaatcccagcactttgggaggctgagaccagaggattgcttgagcccaggagttcgagaccagcctgcataacatagcaataccccatctctacaaaaaatacaaaaattagtggagcatggtagtgcatgcctgtactcccagatactcaggaggctgaggtggaaggattgattgaacttgggacctcaaggctgcagtgagccatgatcacaaccctgcactacagcctgggcaatagaaggagattttctcaaaaaaaagaaaaaaaaaaaagagaagaaaaaagttgaattcacagaagcagagtagaatgatggttgccagggtggggaagtgggcagatgccaaaggacacagaatgtcatttttagagaagaataagttcaggagatccatgggacaacaaggtacctatagttaataacaacatatcatatacttggaaatcactaagagagtagattgtttaagtgttctcaccccaaaaagtaagtctgggaggtgatatgttatttagcttgatttagccatttcataatgtatacatacctcaatcacatcatgttgtataccctcttgtacataatttttgccaattcaataaattcaacaactccaaaaaacaagacattctctttacaaaaataattgttaaaaataaaattcagaattctattttatttatttatttatttttgaaacagagtctcgctctgtcacccaggctggctgaagtacagtggttccatctcggctgactgcaacctctgtctcccaggtgcaaacgattctcctgcctcagcctcccaagtagctgggattgcaggtgtgtgccatcacacctggctaatttctgtatttttagtagagacagttttgccatgttgaccaggctggtctcgaactcctgaccttaggtgatccgccagcctcggcctcccaaagtgctgggattacaggtgtgaaccactgcacctggacagaatataaaagattgtttaattcaactaaaacattaaaacacagattatttctataagtggtaattgttctaacatgttttggtcaaaatagtctccttacttatccacaattaaatggttaattgatatttgattggatttttataaagttttcaaatcatgattgacttttccaatgtacagtaaaatgtgtttgaaaatattgcataaaaattaatatttaaaaatggtcaggcatggtggctcatgcctgtaatcccagcactttgggaggccaaggtgggccgatcacttgaggtcaggagtttgagaccagcctggtcaaacctcatctctactaagaatacaaaagttagtcaggcatggtggcacgcacctgcattcccagctacttgggaaactgaggcaggagaatcgcttgaacctgggaggtgggctccccaggcttaaagcaaaacccccatcttgtctgtctccactctcatcccaggcaatcgccgtcatttccacagcctcaaccactgtctacctgggatgcctcccaagcccgggtcgccagcccaaacctgccttcctagccccagacccatctgtcctggcacacattgccccctgggtccccagcaacctcagccaatgagaccaatgccaacttcctgtccttgcctgacactgtcagccctgagatcagacttgaccattcacctccagtacctgataggtccgtcagtcctttggaacatatcccacgaacattccccaaaccaggcaccggactccacacatcaacaccgtcacgtgagtcaccagcatccctggcagggacccctgtcccagcctgcaactcatctccttcctgtcccttgagttctgtgtcacattccagaggccacaagaagaaaaatgaccaccttaatgaaattaaaagaattgagaagacatttctctatggtccaaaatctttccaactgagaaacacatatcaagatccagcctgctggccctgtggttaaatgttcctgaaataattaaagcccagggcaacacagcccccactccacaagtactcccagcacagtaagacttgcttctctacaggggcttgaaatgtccagtgtgtaccctgcccctctctgtcgtagctaacaggaatgtgctccgtgtcttcttcctgctcaaaggaccgtccaccaacctgcgcaggcagcactttcggcaaggggaggatgggagaacatcctaccatttcccacttactcactgcattcatcaggagcctgcctcacaaattacaagagcgccacggcagacccacgatgttccagcgggtggccatgtcttcatgtcaacttgaaagatcatcgccagggaaatatctatatctcggcagagaacttcagcctgtgtagtccagctgtgctcaaatggaaatccaaaaacccagatgttggtcaaaacaccctgtctcagggagctggctctgcaggtccccagtgtgagagtgaactgggtgggccacctgacctgtctacccacatcccggcctcctggaatcctggaccctgagaaccagggggatgtggtggggagcaggcaagtcttgtgcagaaagccaagatgccacccaaatccactctgcagtctaggagggcgatattctggtctgcaccacaccagtgcacgaggggatggaggatggagtctagacaagccaaatgtaaaaatatattgtccaagtattttgtgctttgtctgtgttacaatgcaatgacaagcccagtgtgctggctcacacctgtgatctcagcaacttgggaggccgaggcaggtggatcacctgaggtcagaagtttgagatcagcctgcccaacatggtgaaaccccatctctactaaaaatacaaaaattagccaggtgtggtggtgggcacctgtaatcccagctactctggaggctgaggcaggagaatcacttgagcccaggacgtggaggttgcagtgagcagagatcatgccactgtactccagcctgggtaacagagtaagactctgtcttaaaaaaaaattaaataaataaaggctatgcccagtattttccatgtactgtcttattatctcagtaaatcccatataactttcctatgaaagtgtatctcatttatctccattttatagatgagaaaactgaggcccctggagtagtattaattttccaagaccgcattgctcataaagggtacagcagggacccaagctcgacactctcaccctcaaacatttccacaagtgtagaccaatggctctcaactggggtggttttgctcacgtaccactcccttgccccacagcattgaaaccatctggagacatctggggtagccatagctgggagggtagaatggcacctagaggatggagaccacagatgctgctaaccgtcctacaatacacaggatgcccccccaccaccaccacgaatggtctcaccccaaatgttgtgactgtgccaaagctgagaaatccaggtttctcctcagcaagaaggaaaatacctgcaacgtggatgcacctctacaggagcctcaggctgacaataaccttcctgatctggtttcaaccctggatgcttttacctggtgcgtccatcagggatttcagggactccagtgagttatcaccctcgaatgctcggttctgcctgacaacccagaaatctctgccaaggtgcctggtcttggggaaggctcagcaagcagttgaggttgacaaccaaatacctaggagagacttttctctgtctccagaaggagctgtgggtcagacacaccctgagatcattcacaagcggtcaataaaggcttggggaggggcagattttctaggccttctcaatggggtgggtgtttgtggatacacaagaagcctgtgaaacttctgatattggcaggaaatcaatgcccccatcctccacccccacccccacctccccaccataaacacatgccctgcagcaggacttgacactcaggggctcctggggtcccgatttatctgctaaaacctcctctagccaccaccgaataaagcaaccccttgcgacccaaccacaagagcactgcctggaagcaactccaagggacaccaagtcacattaaaacctcagccatacagagcaccaggcctggtgatgagaaagaacattttatccttaaaagcatctgaatgcccatgctgcttcttgcagagaaaagtccaaaataatctgttattaaagaacgaggatggttttgacatttttaccaagctagtggtctacgcagacaaaatctcataaaagggcactctgttcttcttgatccactcagacatggcctgtgagtgaagaaacgggctctcctcctcaaagaaatcactgctgatcctcgtaccagcctgacactgcttcatgggttcttcaaagagagtattcccataggaactaaaagggaagaggaatgtgtctggcgggcattgtgggcagcagcgagctttgggccaaattttaagtttgaaaatcaagattccctcttttcaaggggctgccggactgagcagatacaggcaccatgaaaagagggtgccatgttcagattcaggaaacaaggatggtttctattcagttcatccatcatccttcaggtcatgctattcccatttccctctgtggaccaaaaaattcagcggggtttctgccttttaaacatttcattatcaacatatcatccttttagcctccagaaagcattttaacatggagattctggcttaagactcttgtgggtctgtctgtctctctctctcttttccttgaaacggtctcactttgtcacccaggctgaagtgcagtggcgtgatcacagctcactgcaacccaaccttccaggctctagcaatcctcccacctcagcctcccaagtacttgggactgcaggcacacaccaccataactgcctttttttttttttttttttttttttggtagatatgaggcttcaccatgttgcccaggctggtcttaaactcctgggctcaagcgatcctcccccttcggcctctcaaagtgctgggattattggcttcagccaccatgcccagccaaggaccttgtctcttgtgaagtactccagaacaaaacatcactgcaaaaacacatcagggcatgagttttagtcttaagtcccacttatccaccatacactatgtgccaggcacaacgctaagtgcttctatggacgagcttcccttaatctcagcagcaacaaccccaggcaatggagcctgttgacagatccatttgccactgaagacagtaaggctcagacagggtaagtggcttgtgccatgtcagccagctaaggaggggcagaaccaggatgcaaaccccagccgcctggctccagaatcgcgttcccaaggtctcactacacttggtcactccaccgcattccggtatcctggtctttggcagagtccacgtaaaagagggaggtagagggagtgagagggacttcatgcaataaagtttcccggcgttacactgccaccgtaattgtgtccccaaccaggacctctcccttctcatcctttccgtgatcggccctggaaaaccttccaaagaactgtcctccttctcccgggatctcagagaaaattcacctgagttcagtgtccaggtgacccaagctctgaatgcggtaacgtggacggggagaagaggatgtcaccatgagcaagcctcccagacagcatccaggagcaaccccaagactgggcgggggggctctgatgccgcccacggcgaggagggctgcccatgctgcctaaatgggttcagaatgaagaccgccctctctcccatgtggggctcattaaccacgaatccaattattaagacaagctcagctgagcaaatggtcaaacataaaaacatgtggaaggaacaaagaggtcaaccccattatccattaaaaaccatcaaggtggcggccctcactgaggggtacagttctccagcgggccctcatctgccctccaaacccacatgcctccccagtggaaggccagcaaagccacacaggaagagttggggtaggaaagcagaaagtgaaccccaggaggccagcctggctacgcagccccatcccacacacactggcccggtgattcaggggccaacgtttgcaggacaccgggagctcacagggacagcgccccggggatgcaaggaactttgcctctctgtccttctctgtagggatggaaagaggagagcgatttctgggatggaagccatctgcctcctctcaactcttgctgcccaaccagaaagggaagaaaaacaggaagatgcgggacaggtgaggagctgggtgagcgccgccagcccgcagtccagccaagcagggcttggccaagcctggcgccagggacttcccccctacccccaccactggcccctcgccaggtgagaggcaccaacagggtcccagacagatgccccagacaggatgcccagcgcaacacccgccacttcccctgctaggggcccccaggacgcggggctgcccctctctttttggccagccgcagagtccagtgggtctcccagccagcgacgtcgtgggagaatcaggaagtcaaagccacacagccgagaagcggcagctggcgtctcggaggccgtcacgcgctgtcactccgcgcccttcggagttgccgctaaaataccaacttcaacccggggccggccacggagcctcccgccgcccctaccggcgcccccggcacccccggaccccagcgcccgcgtcacttactcctctgcggtcgccacctgtctgggtgccggtctcctccctgcctggccgcggcgcgtcctccccgttctcgcagtcctcgggctgtgcgcttcccccctccagctacagccccagcctcttctcttcgggagggacgtcgtcctcctccctcctgggccggccatccctgcctcggggcttgccagtggcttcggagctgccggaagggctggccatggctcgggggctctgcctgcacctggagaagaggaaggacacggcccgagcggcctctcggtggagctggggcgtctgagcgcgggctcggtgggtccgcgcggcgcggagctgggtataggggccggcgcgggctcctccgcgggccgcgcctggctctctggcgccctcttctggccgctctcgcgcacctccgccacgccgggcccaggcctgcgcagctctcacatgtcctggcccaggaggtcgctgtcccttgcccatggacaggcccgctctggcaatgccctgcacctcctccccgccccggccaggttgcaccccgatggtctccctgctcaaggaggagagaagagaagggacgccactagagggtggacatcggccacagccaccttgtctttgctcttaccctgtgtcttccaagatttggaggtggtgggaaacccgaggctgctcaaaactcgtggagaattcctcctgcaggatgacatgaatgcaccttcccattgcctaccaacagatcttttttgagcatcactgtggaccagtcgtggtgatgggggaggggatattgtggagaacatgacaggcattgccttcacccagtggggctcagctctgggtgggaaggcattgagaatggacattgtcaactgggccaaaggaggccaaggagaagtgctgggggcatgggaactgaaaaagagaggaggctcagcacgtctttgagctgggagagggacagcagcagcggcttttccaaaggaagcaacagctgagagaggtctcagagagttgttctcagcccagtggagggtgttcaggcagagggaacagcgtgtgcaaaagcccagaggctgggaaagaagcagaaagaggactgtggggctggagcatggtgggcaaggggaggaaggtgtggtgggcagacagattgcctgggacccagccgtgcaggggcagaggagatacgggatccttgcaggcccccagccggggctcaggcacagagacagtgcaggtgggcaaagggaggagacgtggagaaatattttggaggcatgccctgatgaatgagcccaggatgcacccttagtgtcagtgtggagctccttccttgactgtgtgatgagctgaactcgggggtattttctggacattgaggtgctacaccaagagcccaggacaggctaagtgagcactagcagctcctggcccacctcaaaagcaggagagacaggggagactgaggaggccggggcggaaggggaagccaggaaggtaggagaggccagggaagcagaggaggcccgggaggcaatggaggcaggagaggctggggaggttatgtcctttccatgattctgccctcgatcctaggcccctgaactccctgagcttccccaccccaagcgctggaaccatgttgcacaatggtctccccactaagctcctgatggcagcccctaccctgctgtgctccctgtttcaaccctaacagctctcacagtgggcagcacatagtaggtgctgaggaaacactggtgggagagcacgtgggtctgctcagcaccttcctctctcctccagctctcccctgtcacgaaataattctgataacgacacatggactttgagaccctcttctattactttccatatgctaatccatctatacctcacagcagccctgggggtgggtgcaatgaggatgcccattttatagaggaggagactgaggtataaagagggtaagtgacatacgcacactacaggggctggggtcaagtgatcagagcactcaatccccaaaggcaaggtggatgcagttaccataaaagacagcagagtcaaagctgtaaccagaatagactgactcgcagcgacctatggtgcctgttgatcctggctttcctagaagtgaaatagataagaagcctgccacatttttactggaactgtgtttgcagaagtgttctaggtcaagtgagcagaagtctaatctgattaataaaaacagagtcacagtccccggtcaatttccagacataagccagttcacagacctggagtcccttgtgtgaatgggaagccaggtcccctccagaaaggactctgctacactgccaaaaatttatactgtcaatctttctcccagcctgcccccaagggaataaacagccttttgctaggatgactgaacaggagaaaaggaactaatgggacctgtgcaggatcactggacacaggctctgaactggcactaggatgagactagggtctaccagtcagaataggcattttgaaggtcaggtgaatgttggtgcaagttcatgacacggtaggtccattgggtccccaaatccatcctctggttatatacaaagcggcaatgctgagattcaaattcagggcatccaacatagaggctgggctcttactcatgaaacattctgacactagtaaccaatttaaaaatgtaaacacctcctggggctagtgagagtcctccaaacagtcatgtaaattggttctgtcaaggatttccccccacccactgctgagagccagttgcaaggagagactagggaagggcattgggtaactttgttgctaaaagctcttctggataaagacatttgggaaaagaagcaaatagagttcagcagaagaggtaagaaagtaagtttatgtttggccaggcacggtggctcacgcctgtaatcccagcacttgggaaggccgaggcgggcagatcacgaggtcaagagatcggactatcctggctaacatggtgaagctccatctctactaaaaattcaaaaattagatgggcatgatagcgcacgcctgtagtcccagttactcgggagcctgaggcaggagaatcacttgaacccaggaggtggaggttgcagtgagcggagatcatgccactgcactccaacctgggcaacagagtaagactctgtcttaaaaaaaaattaaaataaataaatgctatgcccagcattttccatgtactgtcttattatctcggtgaatcccatataaccttcctatcaaagtgtatctcatttatctccattttatagatgagaaaactgaggcccctggagtagtattaattttacaagaccgcattgctcataaagggtacagcagggacccaagctcgacactctcaccctcaaacatttccacaagtgtagaccaatggctctcaactggggtggttttgctcacgtaccgctcccttgccccacattatttgaaaccatctggagacgtctggggtagccatagcagggaaggtagaatggcacctagaggatggagaccacagatgctgctaaccatccttcaatacacaggacagccccaccaccagcaccacgaatggtctcaccacaaatattctgactgtgccaaagctgagaaacccaggtttctcctcagcaaaaaggaaaatccctgcaacgtggatgcacctctacaggagccccaggctgacaataagcttcctgatctggtttcaaccctggatgcttttacctggtgcgtccatcagggatttcagggactccagtgagttatcacccttgaatgctcggttctgcctgacaacccagaaatctctgccgaggtgcctggtcttgcggaagactcagcaagtggttgaggtggacaaccaaatacctaggagagacttttctctccctccaggaggagctgtgggtcagacacacactgggatcattcacaagcggtcaataaaggcttgaggaggggcagattttctaggccttctcaatggggtgggtgtttgtggataagcaagaagcctgtgaaacttctgatattgggaggaaatcaatgcccccatcctcccccctcccccacctccccaccataaacacatgccctgcagcaggacttgacactcaagggctcctggggtcccgattaatctgctaaaacatcctctagccaccaccgaataaagcaaccgcttgccacccaaccacaagagcacagcctgggagccactccaagggacatccagtcacattaaaacctcagccatccagagcaccaggcctggtgatgagaaagaacattttatccttaaaagcatctgaatgcccatgctgcttcttgcagagaaaagtccaaaataatctgttattaaagaacgaggatggttttgacatttttaccaagctagtggtctacgcagacaaaatctcataaaagggcactctgttcttcttgatccactcagacatggcctgtgagtgaagaaacgggctctcctcctcaaagaaatcactgctgatcctcgtaccagcctgacactgcttcatgggttcttcaaagagagtattcccataggaactaaaagggaagaggaatgtgtctggcgggcattgtgggcagcagcgagctttgggccaaattttaagtttgaaaatcaagattccctcttttcaaggggctgccggactgagcagatacaggcaccatgaaaagagggtgccatgttcagattcaggaaacaaggatggtttctattcagttcatccatcatccttcaggtcatgctattcccatttccctctgtggaccaaaaaattcagcggggtttctgccttttaaacatttcattatcaacatatcatccttttagcctccagaaagcattttaacatggagattctggcttaagactcttgtgggtctgtctgtctctctctctcttttccttgaaacggtctcactttgtcacccaggctgaagtgcagtggcgtgatcacagctcactgcaacccaaccttccaggctctagcaatcctcccacctcagcctcccaagtacttgggactgcaggcacacaccaccataactgcctttttttttttttttttttttttttggtagatatgaggcttcaccatgttgcccaggctggtcttaaactcctgggctcaagcgatcctcccccttcggcctctcaaagtgctgggattattggcttcagccaccatgcccagccaaggaccttgtctcttgtgaagtactccagaacaaaacatcactgcaaaaacacatcagggcatgagttttagtcttaagtcccacttatccaccatacactatgtgccaggcacaacgctaagtgcttctatggacgagcttcccttaatctcagcagcaacaaccccaggcaatggagcctgttgacagatccatttgccactgaagacagtaaggctcagacagggtaagtggcttgtgccatgtcagccagctaaggaagggcagaaccaggatgcaaaccccagccgcctggctccagaatcgcattcccaaggtctcactacacttggcctctccaccgcattctggtatcctggtctttggcagagtccacgtaaaagagggaggtagagggagtgagagggacttcatgcaataaagtttcccggcgttacactgccaccataattgtgtccccgaccaggacctctcccttctcatcctttccgtgatcggccctggaaaaccttccaaagaactgtcctccttctcccgggatctcagagaaaattcacctgagttcagtgtccaggtgacccaagctctgaatgcggtaacgtggacggggagatgaggatgtcaccatgagcaagcctcccagacagcatccaggagcaaccccaagactgggcgggggggctctgatcctgcccatggcgaggagggctgcccatgctgcctaaatgggttcagaatgaaggctgcactcccaacttcaacccggggacggccacggagcctcccgacgtcccttcgtcgcgtccccggcacccccgcgcccgcgtcacttactcctttgccgtcgccacctgtctgggtgccggtctccttcgtgcccggcagcggcgggtcctccctgtcctcgcagtcctcgggctgtgcgcttcccccctccagctacagccccagcctcttctcttcgggagggacgtcctcctcctcctcccttctgggccggccatccctgcctcggggcttgccagtggcttcggagctgctggaagggctggccatggctccgggggctctgcctgaacttggggaagaagaaggacacggcgcgagcggcctctcggcggagctggggcgtctgagcacgggctcggtgggtccgcgcggcgcggagctgggtatcggggccggtgcgggctcctccgcgggcggctcctggcactctggcgccctcttctggccgctctcgcgcacctccgccacgccgggcccaggcctgcgtagctctcacatgtcctggcccaggaggtcgctatcccttgcccatggacaggcccgctctggcaatgccctgcacctcctccccgccccggccaggttgcaccccgatggtctccctgctcaaggaggagagaagagaagggacgccacgagagggtggacatcggccaaagccaccttgtctttgctcttaccctgtgtcttccatgatttggaggtggtgggaaacccgaggctgctcaaaactcgtggagaattcctcctgcaggatgacatgaatgcaccttcccattgcctaccaacagatcttttttgagcatcactgtggaccagtcgtggtgatgggggaggggatattgtggagaacatgacaggcattgccttcacccagtggggctcagctctgggtgggaaggcattgagaatggacattgtcaactgggccaaaggaggccaaggagaagtgctgggggcatgggaactgaaaaagacaggaggctcagcacgtctttgagctgggagagggacagaagcagcggcttttccaaaggaagcaacagctgagagaggtctcagagagttgttctcagcccagtggagggtgttcaggcagagggaacagcgtgtgcaaaagcccagaggctgggaaagaagcagaaagaggactgtggggctggagcgtggtgggcaacaggagagaggtgtggtgggcagacagattgtctgagacccagccgtgcaggggcagaggagatagaggatccttgcaggcccccagctggggctgacgcacagagacaatgcaggtgggcaaagggaggagacatggagaaatattttggaggcatgtcctgatgaatgagcccaggatgcacccttagtgtcagtgtggagctcctttcttggctgtgtgataagctgaacccgggggtattttctggacatcgaagtgctacacccagagtccaggacagactaagtgagcaccagcagctcctggcccacctcaaaagcaggaaagacaggggagactggggaggccggggcggaaggggaagccaggaaggcaggagaggccagggaagagaggaggtcagggaggcaggggaggcaggggaggctggggcggctgtgtcctttccatgattctgccctggatcctaggcccccgtactccctgaccttccccaccccaagcactgtaaccatgttgcacaacggtttccccactaagctcctaatggcagctcctatcctgctgtgctccctatttcaaccctaacagctctcacagtgggcagcacatagtaggtgctcaggaaacactggtgggagagcacgtgggtctgctcagcaccttcctctctcctccagctctccccatcatgaaataattctgataacgacacatgggctttgagaccctcttctattactttccatatgctaatccatctatacctcacagcagccctgggggtgggtgcaatgaggatgcccattttatagaggaggagactgaggtataaagagggtaagtgacatacgcacactacaggggctggggtcaagtgatcagagcactcaatccccaaaggcaaggtggatgcagttaccataaaagacagcagagtcaaagctgcaaccagaatagcctgactcgcagagacctatggtgcctgctgatcgtggctttcctagaactgaaatagataagaagcctgccacatttttactggatctgtgtttgcagaagaattctaggtcaggtgagcagaagtctaatctgaatcataaaaacagagtcacagtcccccgtcaattcccagacataagccagttcacagacctggagtcccttgtctgaatgggaagccaggtcccctccagaaaggactctgctccactgccaaaaatttatactgtcaatctttctcccagcctggccccaagggaatacacagcctttaccgggatgactgaataggagaaaaggaactaatgggacctgtgcaagaccactggacacaggctctgaactggcactagggcgagactagggtctaccagtcagaataggcattttggaggtcaggtgaatgttggtccaagttcatgtcatggtagatccattgggtccccaaatccatcctctgcttatatacaaaatggccatgttgagacttaaattcagggtatccaacttagaggctgtgctcttactcatgaaacattctgacactagtaaccaatttcaaaatgtaaacacctcctggggctagtgagagtcctccaaacagtcatgtaaattggttctgtcaaggatttcctcctacccaccacccccaccactgaaaaccagttgcaaggagagactagggaagggcattgggtaactttgttgctaaaagttcttctggataaacaagagccttatccaggaaaaagaagcaaaatagagttcagcagaagttgcgaaaagaagcacatagagttcagcagaagaggtaagaaagtaagtttatgtttgaccaggcacggtggctcacgcctgtaatcctagcactttgggaagccaaggcgggcagatcacgaggtcaagagatcgcaccatcctggccaacaaggtgaagccccgtctgtactaaaaattcaaaaattagctggccatgatggcacacgcctatagtcccagctactcgggagcctgaggcaggagaatcacttgaacgcaggaggcagaggttgcagtgggccaagatcatgccactgcattccaacctggtgacagaattagactccatctcataaaacaaaacaaaacaaacaaaaaaatgtaagcttatttttaagcctgaacaagtgtagtggtttaggggttctgcaaacacggccccaatcaggctacaagatgttctggcagcaatatttacagccagtcactcctggccggctgagccacttttcaaaacacccttgcacggctgtgcagagaggctggctccactggcagccggcagagccataactcacagtgtcaccgctgccctcaaaccacttcggtaagcactttgtatttttgagacggagtcttgctctgtcatccaggctggagtgcagtggcacaatctcggctcactgcaagccccgcctcctgggttcatgccattctcctgcctcagcctcccaagtagctgggactacaggtgcccgccaccatgcctggctaattttttgtatttttagtagagacggggtttcaccgtgttagccaggatggtctcaatctcctgaccttgtgatctgcctgcctcggcctcccaaagtgctgggattacaggcgtgagccaccgcgcccggcctggtaagcacttttaatcaatgcaacaggaataaacatttgctgcagagcggcaatttgcagggaagaacatgcttccacttaggatcagaaagcaaaacctcctggctgtttgcatctatgcaagagctcacaggaaaagccctctgtgtggctgccagcctcacacactccccacaaggggtgagtttctctttccatgttaatctatgctctgacgtgccatctgtcaaccaccacaccattctcagttgacatttcaaagcatctttgccctgagaatggtcaccagctctgccctgcaagcccccaggtgacaatgaacttaaatgagagagaaaacaggtttcgaggtggatttcagttcagcatcttggagtctctgtgtggacatgaaatctgtctccacagctgtggactgcatccttgtttgtcatctggtttggttcttggggacttggaaactcgtgggcacctttgcaatttgtcaagaagctgcacggcccttccaacaaaagcaaggaataggaacagaagcccaaggcttcagatcaaggtgcaatttaaagcagcctcagtataaaagcaaacaagagccagagggatgcctaagggagagtctagacctcagggcagctataaggcaaagagaaagagagagagagagacagagacagaaagacagagagagatgggaggagacatgaggcacccaggcatctggatcaaaatccctacaagaggggcctcctaaaaattcaggaggctgaggtgggtgcacacagaagttcaagactagcctggcaacatagcaagaccgtgtctttacaaaaaatacaaaaattagccgggtgtggtggtgtatgtctgtgttcccagttacccaggaggctgaggtgggaggattgcttgagcccaggaggtagagctgcagcgagctgagatagcaccactgcactccagcctgggcaacagagtgagacttcatcacaaaaaaatttaaaaaaatttttaaaaaggatcaccccggctactcgaatggttaataagaaggtaagagcagaagcagggacattctgcaggtgggagtccacagaggctcagaccaggctggggctgaagactgcctgaattctgtgtatattttgatgatgaagaaactcaccgactcttgaagagtgggctccaggagatggtatttttaacaagctctcagagtattctaatgcaggctgaagttgaagaactggtttaggtgaagcttctgtttcatccttggggaagtacctactgacttttctctaagccaccacaaaagaggtgctagacaagatgtgctccaatgtctgaacatgtgtgcacagctgtagagccaacctaaggacactgagtcaaaggttaggagtacaacagtgaacaaccactgtcctcttttcaataagctttgcatttaatgagagaaaaaaaagcaaaaaaaaaaaaatcattttcaactcagaatggtaagagttatggtgacactatgcctggggcaatgggagcacatagaaggggcacccaatcggccaggtgcagttgttcatgcctgtattcccagcacttcgggaggccaaggtgggtggatcacttgaggccaggagttcaaaaacagcctggccaacatggtgaaatcctgtctttactaaaaatacaaaaaaattagccagatgtggtggcgggcacctgtaattccagatactcagaaggctgaggtgggagaattgcttgaacccgggtggtggagattgcagtgagccaagatcgcaccactgcattccagcctgcatggtcagagcgagactctttcaaaaaaaaaaaaagaaagaaaaaagaaaaagctcggaggtgggtgggcatgcaatctatatcaggtggtgagaaatccttctccaccacaggactcctcagttgaagactagaaaatggaaggaactagccaggttgataggagaggtgtggaagatcattcccagcagagggaagagcatgtgtaaaaatcgagacgtggagggtgaggagttgagagatgttcatataattgtaaaaagtgactaatatagaggtaagttggaggcaaatcttaaaggctctttgtcgtgtctatcctgtagacaaagggagacagtagatgtttttatgcaggggagtaatgatccactttgtgctagaagaagagtagtctggctggaggagagtgggtggtgagtagaccaggtaggaggctgcaatacgccaagtgagacaagatggttggctggaccaaggctgtggcagtgaggatggagaggagacagtagactaacttgactgagaaagagggaggaatgaaggaggaggcccaggtgatttggaagctgggtggatggtggtgtgaatctgacgtggtgagccctggcagaagaggaaatcaggagaggaaaggtaagatgaggtcaatgcaagacagacagccaagtggagataacaactgggcagctggattcatcagcctggagttatacagagagctctggaatggaaataaagaggaaaggactttgggaataggtgaatcctcccagaataatgtgtaagaaaggagaatagaacacaggggacagaaaaagggaagagatttgttattaaaaccaaccatccatcagacatcttccaataaaacacttgttagaggtttcctcagtgtgagttattcaggaccagagctaaagaccatattcccaataaaataactgctgggaaggtcttcatgaaaatatttaatgctgcttttaaaacaacaacaataaaaaggctttagctactgcacagaccctggagcaatttttcagcaagtgtctatcaaacacgaatctgatctgactcaaggaggtgtcatatcaagtgtaaaaatccaattccaatgtccataagagcctttctgccaggtacaagaccctaatccagttgaagtgattttctattgattaataggctgggaatacacaggttgttggtttttgagatttccctccctgtgccttcatgccagctgtgaaagagtcaaaaggctcctaactgtcaaaataaaaatgacacttcgtcacagaggaagcagattataggtcaatcacattgatgactttttaactatgagaagccattaatgttactgaataagcaaatctgtttgcataagcagatttttataggctactgggaataaaggttttcctaagtgggtgatttgtacaacgatagcctttgggtctctgatggaacagctctgacgaggaaatgttcctttaattatgtggaaggccaattaccacgttatagccacattgttttgcagattgcatataatttcaccatttccatagcttcagcacgataattctggagaaaattcaggcaccaaggagacacttgaggcacactatgctggagacagatgttttagcgaattcagtttaagcttcaacattaaagttattttgttgaataaaacataatgcaataatgagcttgtgtatgtcaactctatagtgcaggtaataatagctagagagagcatgtcccgtctcctctttttaatgctcatttgagtaatacataatgctatagagagaacttttctctaatatgtgcttcacctcaggctaagcgtgttttgggcaactgtgcttcatgaaaaaaaaggtaaaggatctaatttgggagccactcacaaaagtgttaccacttgatgtttttttatactctgagatttcttattcccagtgcctaccaggaatggactttctggagaagctcagattaatcactccttatgagaggtaacagcgtgctggcagccctcacagccctcgttcactctcggcacctcctctgcctgggctcccactttggcagcacttgaggagcccttcagcccacggctgcatggtgggagcccctttctgggctggccaaggtcagagctggctccctcagcttgcagggaggcatggagggagaggcatgagctggaactggggctacgtgtgctgcttgcctgccggctggagttctggatgggcgtgggcttggcggccttgcactaggagctgccggctggccttgccggcccgggccgtgaggggcttagcacctgggccagcagctgctgtgctcgacttctcactgggccttagctgcctccctgcggggcagggctcgggacctgcagcccgccattccttagcctcgcccctctgtgggctcctgtacggcccaagcctccccgatgagcaccgccccctgctccatggcacccagtcccatcgaccacccaagggctgaggagtgtgggtgcatggagagggactggcaggcagctccacctgcagctcctgtgctgggtccactgggtgaagccagctgggctcctgagtctggtggggacttgtagaactttatgtctaggtaagggattggaaatacaccaattggcactctgtatctagctcaaggtttgtaaacacactaatcagcaccctgtgtctagctcagggtttatgaatgcaccaattgacactctgtatctagctactagggtggggacttggagaacctttgtttggacactctgtatctagctaatctagtggggacgtggggagcatttgtgtctagctcagggattgtaaacgcaccaatcagtgccctgtcaaaacagaccactcaggctctctgtaaaatggaccaatcagcaggatgtgggtggggccaggtaagagaataaaagcaggctgcccgagccagcagtggcaacccactggggtccccttccacactgtggaagctttgttcttttgctctttgcaataaatcttgttgctgctcactctttgggtccacactgactttatgagctgtaacactcaccgagaaggtctgcagcttctctcctgaagccagcaagaccatgaacccactgggagaaatgaacaactccagacctgcagccgtaagagctgtaacactcaccgtgaagatctgcagcttcactcctgagccagcgagaccacgagccccacctgaaggaagaaacttcaaacacatctgaacatcagaaggaacaatctctagacacaccacctttaagaactgtaacactcaccaggagggtccacagcttcattcttgaagtcagtgagaccaagaacccaccaattctggacacacttatacacttggcactgggaggtctgtatggagcaagtgaagaaatcagcagagtgaagatagaaggagaacaacatgatgggggaaaggcaaagttagtgccacattggtttcaattctgccactcatgagtgagacccgtgacctcctctctctaagactctgttgttcttatctgtagagtggaggaatagaagggccttttaaagtattaacatttcctgacctatctgtaaaacactttcattcaaactgatgggaatcttgactgctttgccaagagggcataataatcatcaagctgaatgcaccaaacagcattgcctgaaactatctaagcaaaatctgagaaagttacacaggacagacaaacctcctatgagagtaagaactcttcagcacatgcttagtgtgtcaaagacaatactgtgttcacaccattcctcttcctggacatgcagaaagactacatttcccagcctcacttgcagttagtttggaaccatgtgactgcatttccaccaataggaatgtaagaaatcacttctgggccaaggttatcaaagtgtgagctatgttccctctcttcctattcatatggctacaagtgaaaaactctgagatggcagaattaaaagatggaaacctgcagaatctctgaatcactgttggacaagggcccccaaagagaacccctaccctgcaccagactatgctatgggtgtcaacccactgagagttcagagtttattcgtctcagcagcagtctattgttacactgactaacatcctgaggtttgagaggtctagcatattgttaactgaagttagatttcaattacactgagaaccttatctatttaaaaataaaaactctcctaaaaaaaaaatccacattccttttaaccacatgtggcaaatttgcaaaaaaaaaaaaaaaaaaaaaaaaaaaaactggccacatattaggccataaataagtctcaacaaaatccactatacgattgacagtgtccagagcacattttcctgaccataatgccacaaaattagaagtcaacagcaagaagatagctaaacgcaagcatatatttggaaaattaaaaatatcctttcatgagttaaatgaaaaatcataatagaaattactaaacatttacaactgaatgaaaacacaactttatatatatatgtatatatataatgtgtatatatatatatatatatatatatatatttttttttttgtgagtcttccaaatttgttcttcttttacaaggttatttgggaaattctgggtctcctgcaattcctcttacagttttatgctgtgtgtcaatttctgtggctgggtctatgagaacttattgtagttctcatagaccagggtttgcatgttgctgtctagagccctgatctgctgcaccatgtccgtctcactatccatcagctgggccagagggcactctctaggaagcttgtctaggtaaacttccgggtcgaagtgcaccccgttcagatcagtggggtccaggggttcggtccccgcggggagtcccaccgcctccacttccgagaggccgttgtaaaacttcagcatcctgtccgccttccaccgacgctccttgagcctccccctcgggcccttctggggagtccccaggtccacaccccgggctaggcccagtgacagctgccgccgccatagctccaactgcagcccacgggcgtaacttttatatttttaagttggatacatggagctacttggcttttgctttcatcacctcgttgaggaaagagctggttgcttatggtacccctgtttttactgcaacgtgtaatggatgagaacctccctgttgcagagagcaaaacactgaactaaattgtgctgtaacacagctctgtattgggggagtgggagtgatcatgcaaacgcttgcaaatttgcacagtgacagagacaatcgtttgggcagctgttcactatatgaaaaggcaattgaccaaaagtcagttactgagctatctcaatactttcattttattttaacttttggcagcagggtgcaattaaaggagagaaagaaaacaaagtgataagtgtaaaataatgtacacacatgtgtaaaagaaaatgacaagacaggatgactatttgtctcttggttagctccttgggctctatgtctccttcctcggagaacctcgttttcctttgcccagatttgttagggtggataatccaggcgcctgctcccccatgatggaagccaaagacgtccctggagcagcgtcccgctgcatcctttcctgcactgcccacatggacacaactcagccgattagtcttcctctcagaactttagtcttgagcaaagggattaaagggtgaagtgactgaaggtatgcccttccaaagtggtacgtgagctaatggctaaagtttgccaagcccatccaagcactttttttcgtaatttttatttatttatttttttgagacggagtcttgctctgttgcccaggcaggagtgcagtggcgtgatctcgattcactgcaacctctgtctcccggcttcaaaggagtctcctgtctcagcctccccagtagctgggatgacaggcgtatgccaccatgcctggctaatttttttgagtttttttggtatttttagtagaaacagggtttcaccatgttggccaggctggtctcgaaatcctgaccttgtgattcgcctgcctcagcatcccaaagggctgggattacacacgtgagccaacgcgcccagcttcaaagagttttaagcagagctcagaggtcttaaccacaggcacatcggaggagcatttttgaaacactttccatcttcctcaataggaatggaagccaaactccgaattgatgactcctttgaggaagttgagagctgtaaggaaagccaggaacaggggcaagggagagatgcgtcccgaatgatcctgtgcaaattctttctggaatccttgatgtgatctcagctgccctttctatacatgacacagtgattgtggcacccactggtctagctgtggtctacaaggaacccccaaagggaagggcacagtgagcaggggcatccgcctgagtgacgaggatttgagagggcaggttggttgcagggagaggacttcccaaatgacatgtgtctggacttagactgcctggttcaaattggacttcaccctttttgacttcgtgatctggtacaagctacgtgaaaatccgttgagctttttctagtctgtaaaatcatcatgaaatgtgcactaataactgggagactatgcagatgaaatgaaacaagctgcatagagcacagagctcagagcctggcctttaggaagccctcagtaagggttcatgatgccatggtgtctgtcgtcatcctctttatcctcatcatcaccttcataatctctttgttgttcttagggaatagctagaggggctgattccctgctatcatgggtgagatgtttatgagaaggacaaccagtgggggaggaaagcaaaattttgaataagatttctgagacccccagcacaaccaagaacataaactgcacagtctgctgagcagagagttgcatattggtctcctcacatctgcccaccgcactctcctgtttgtcctgaggatgaggaaacaaacaagtctcccgaacgtccctcagcactcacttgaaggggtggcctccccctccacagctgtgggtatttccagtcgggtaggacgagagactgagaaaagaaataagatacagagacaaagtatggagaaacaacagtgggcctaggggaccggcgctcagcatacaaaggacctgcaccggcacaggcctctgagttcccttagtttttattgactattatttttattattttagcaaaaaggaatgtagtaggagcacagggtgataataaggagaaggtcagcaacgaacatgtgagaaatagaatctacttcataaggaagttcaaggaaaggtactatgactggatgtgtacgtaagccagatttatgtttctctccacccaaacatctcagtggagtaaagaataacaaggcagcattgctgtaaacatgtctcgcctctcaccatagggtggtttttctctcatctcagaattgaacaaatgtacaatcgtgttttataccgagacattcagttcccaggggcaggcaggaaacagcggccttcctctctctcaactgcaagaggctttcctctttgagtaatccacctcagcacagaccctttacggggggcgggctgggggatggtcaggtctttctcatcccacgaggccatatttcagactatcacatggggagaaaccttggacaataccctgctttcaagggcaggtctccctgcggctttccacagtgtattgtgcccctggtttattgatactagagaatggcgatgacttttacaaagtatactgcttggaaacatcttgttaacaaggcacgtcctgcataaccctagatcccttaaaccttgatttcatacaacacatgtttttgtgagcttcaggttggggcaaagtggctggggcaaagctacagattaacaacatctcagcaaagcaattgttgaaagtacaggtctttctcaaaatggagtctcttatgtctttcctttgtacatagacacagtaagagtctgatctctctttcttttccctacactcactgaactgcctctcccctctgctgggacatgaccacggagaacaggtccactgtcctccctgcgtggtgcaccatggaggctcagactccgtcctcaaggctggcaagaagacagggtgagacatgagcctcctgatacaggtgacggctgtggagaccacaggactgcaacctcacactgcagggctggaggcacagactgagtatttactatcctgtggcctggggggctcaggcacagagctcctcattagccaaagctgcccaagttccccaacctctaaggatgtcctcacaataatgcaagaagaagaagagaaaagtgagtgtccatagaaactttggggctcctcctctaatcagaagaaagctggtgtgtattcttcgcttctttcttttctttttaaacatccaactgctttaattttcatcttttataatgggaaaatataccacgtataaatattaaaaattataaatatatattagttcatatagaatggccagtataaacatttacaatttccactctttttcagtttacagattattgacattaagtacgttcacattatttagcaagcatcaccgccatcatctcaggaacagttttatctttcaaaatggaaattccacccattcaccaagctctccattcctttctctcacccacccctgggggccacctttctagtttgcaactctatgagtttaactactctagacacttgatagataagtggaatcataccgtgtttaatttttttgttttggagacagagtctttctctctcacccagtctggagtgcagtggcgtgatctcggctcactgcaacctccacatcgtgggttcaagcgattcttgtgtctcagtctcccgagtagctgggattacaggcttgcaccactacgcccagctaatttttgtatttttaatagagacgagctttcaccatattggccaggctggtctcgaactcctgacctgaagtgatccgcctggctcagcctcccaaagtgctggtgttacaggtgcgagccactgagcctgggcctgtttatccttttgggatttatttatttcactgacgataatgtcttcaaggttcatccatgttgcggcctgcctcagaagtgcctgtctgttttttttgttgttgttgttgtttgtttgttcgtttgactttgttttgttttgtgtttccatggagtctcactctgtcgcacaggctggagtacagtggcacaatctgggctcacctccgcttcccgggttccagtgattcttgtgccacatcctcccgagtagctgggactataggcacacgcctccatgctcatctcattttttgcattttcagtagggacagggtttccccaagatggccaggctggtcttgaattcctgacctcaggtgatccgcccacctcggtcttccaagacgctgcgattacaggcgtgagccaccgcaccggccagaagtgcctgccttttgaaagctgaatagtcttccattgtatgaaggaactgcagtgtgctttttcattcatctgtccacgaacccttgggttgcttccacattttggctcttgtgaataatgctgctatgaatatgggtgtacacaaatctgtcttccactcctggcttcttttttgtaggtacccacaaatgcaactgcggcaacatctgatcatcctgtttctaatttttccagtagacaccatactattttccccgttccttcacggttttacattccctctgatcagattcgagcattcctacttccctctagtctcaccaatcctgtttgtttatcatatccatcctaatgtgtggtgtcacattcttggtttgatttgcgcttccctatgatgagtgattttgaacatcattttagatgcttattggccactgctatatcttctttaggaacacgtctacttgagtcttctgaccattgttgatgggatgctttgggtttcttgttgtttagttctgcctgttctttatgtatgatggatatcagcctcttttcagatatacgctttgaaaatatttttcctaatccatgggttatcttttcactcagtttgccgtgattttgctgcacaaaagtgtctgtcatttcgatgtaatccaaggaatctaattttcttttgttgcctatgcttttggtgtcacatcccagagaacattgcccaatctgatgtcatgaaagcatggccaatgttttcctttaggcgaatgattcttttagcgcttggggtgaggtctttgatccagtttgtgttaatttttgcccctggtgtgacatagggtccaccttcaatcttctgcatgtggaaatcaagtttctccaacaccatttcttgaaaaggctgtttttccaccaatgagctttcttaccactcatgttaaaaatcatttgaacatacaggtgacaagttatttctgggctccaaaataaacaaacaacagcagacaacagataatgttacagcatgggctgggcgcgtcgctcaagcctgtaatcccagcactttgggaggccgaggtgggcggatcacctgatgtcaggagttgaagaccagcctgaccgacagggagaaacctccgtctctactacaggcgcatgcctgtaatcccagctactcgggaggtggaggcaggagaattgcttgaacccaggaggcagaggttgcggtgagccaacattgcaccatgacactccagcctgggcaacaagagcgaaactccatctcaaaacaaaaaacaaaaaacaaaaaaccagcatgatttcaagagcagaaagagaagagctgaaaaaccagcataatgagaaaattaggaagtttcttaccaaagcatctggaaatattcaagaaattcttgtgaactaaaattttcatactgtacaatcaaacactagaactcacttattccatctttctgtattttgggacccaattatccacttgtcttcattccccatcccaacccttttcttcctagcgtctgctaaccacctttatactttccaccttcctgagattccttttgtgtgtaggtgtgtgatggagtctctttatgttgcccaggttggagtacacaggcacaatccgggctcactgtaagctccgtctcccgagttcaagcgcttcttgggcctcagccctccaagtagctgagactagaggcacgcgtcaccacgcccggctaattgtttgttttttccgtagagacggggtttcaccatgttggccaagcgggtctcgaacccctggactcaattgatccgtgcgactcggcctcccagagtgctgggattacaggtctgagccaccacgcctggtcaaggtttccttttttcttcctacgtagaagtgaggacatgaaatatttgacattctgtgcctggcttatttcatttaatatacagacctgcaatcacatccattttgtctgcagcagagaggattttcttcctctttaggctgaataatacttcattgggtgtgtataccacagtttctttattgaaacaaatttctaaagagcaaatatttttaaagtctcagaatgtgaaacttcagggataccgtgcccattttattcttttctatttcccatcttatgtatatgcaagtgtataacaaatcagcaattgatgtgtgtataaatctataacttcaacaattgcaaaatgtaaatgctaagtggtggctgggcgcggtccctcatgcgtgtaatcccagtactttgggaggcggaagcggccggatcacctgaggtcaggagttcaagaccagcctgaccaaaatggagaaacattgtctctactaacaatacaacaacaacaacaacaaaaagatagccaggcatggtagcgcatgcctgtaatcccagctacttggaaggctgagacaggagaattgcttgaatacgggaggcagaggtttcagtgagccgagaccgtgccattgaactccagcctgggcaacaagagtgaaactctgactcaaaaaaaaaaaaaaaaaaaaaaaaaaggacaggaaggaaatagaaaatgcgaaatggtaagaaaaaacagcataataaacatttgtatggcgttgatggacaatgcatttgaagataatatttgaagaaatcatattacaattaatttctgttcttactcattgcagcttgatgcctctaaaaacttcgtcattggaaccatctctggtgctttaaaagaaaaaaaaaaaaaatccacacactcacacaggtgcaaggaaatcagaatctcaggtattgagaaccagtcctcatcatgtgtaagctgcccaggtgatttgactcaaagccaagattgaggaacggcgacatggatatctacacagaacctgcctaaatagattctctagaagaagtttataaagaaattccacatgaactgtggaagaggatatgaatttgatgtacagtatgtcctcacttaacatctttgaaagtctcttggaaacttcaccttgaagcaaaattatgtacagtgaaaccacttatttttcatcaacagtataactacacgactttgaacaaccaatgctgttggaggaccttctgtacattgtttccataaagtcagttttcagggaattccaaaacgaagtgaggacttcgtgtatataaaatgatggttgtgattccacctggatgacatggttattgctcagagactaaaagaggccacctaggtatagaagattctgtcatgaggtttctgctaaaccaaggatcccagaatcgtcactcattccagataaaggcataacgaagaaagcaatattcacaaaggaaatgcggaaaggaataaaaaccatcaagccacaaaaagaatgtgactaaggggcaggatttgcagataaagagatttaatgtgattgccctttctcacccacacaagaaaaaggatggaacagatcatgagattcgaatgctctgctgcccagcctccgcagggcactttgtatgtccctgtttctcaggctgcagatgaaaaggttcagcatggggtgaccacagcgtacatcactgatgccaccacaccattcctggggggtggtgacacagctgaagtcaggtacatgccaatgcctgttccataaaaccagcaaacaactgctagatgacagccacaggtggagaaggctttatacttcccatctgacgatgaaatccttagaatggaggggacaattttatagtaagacaaaaagatccctgaaatgggaagaaaaccaaacatagtactatcgaaatatatgaatatgttattgatgacactgtcagaacaggcaagtttgagaagttgagaggggtcacagaccaaattagagatttccacattcttgatgatggttaattgtaacacaatccaactgtgcagctgggaatccaacaggctaaggaaaaaggacaccaaaacgaagaagacacagaggtgaggattcacgatgactgggtagtgcagagggcgacagatggctacaaagcagtcataggccatcacagtcaggagcatgccttctatacatgcaacaaggagcaggaaagacatctgtgtcaggcagcccgcatgagagatgactctgctatgcgactgcgtgtccacaatcatcttgggaaccatggccgaggtgaaaccgatgtcaggccagcacaggttggagaggaagaagtacatgggggtgtggagggggcagtcagagctgacagccaggatgctgaacaggttcctcagcaccgtgaccagatacatggacagggacagggacagcaaagcgagggccggctgcagttctggatcctctgagagtcccaggaggaggaattctcagacacctgtgagatattagtcccaacatcccagagggtgtacactacccctgtgatattgtccctaacttccagaggggagaggatgacatcactcccaatatctcagaagttgtacatcccccgtgatattgttcgtcatatccagggaggcgcaggatgacattccattgaatttcgcgacaggcctacacgcacagtgtgatactgttcctactatccaagaagggagaggatgatattactcacaataaagcagtgggtgtacatcacctctgtgttgttgtctctaatatccggggccgggggaggaggggagaggataacattgcctccaatttagcaggtggtttgacgccccttgtgctgttgttttaaatatccagcggggaagacagtagtactatttttgatagtccgattcatcctctccacctttccggaactctgaggccgggaggcggcatgtagtttccgtgcgatccccaatacctttgccgttttctgtaccaaggcagccaaaaacgcaggcccgttgtctgagccgatccataagggcggtcgaaatctaggaatcacatctcgaagaagcacagggattacttcaccagctttctcagttcgtgttggataggcctccacccacccagagtaggtacgcccaagaaccagtacatgcttgttacctccacactttggcatctccgtgaagtccacctggagaccttcaaagggggctgctccacaagctcgtatgccgggcggaacggctggaccttgactcccatcttgctgtcagcaggtaacacaccgctgcctcaccgttttggcaagggttgacaaaggcgagatgtagaaataccggcctaacaacttttccagtgactcctgacctcgatgggtgttttcttgcacagccagtacaactgcagctcctagcagctgtggcacagctactctcctatctggtaactgaatccatccttcctccatcacttgtccttccctctacctggagaaagtcctttcttctttagaagaagcaggtccaagatcaggtgcttgagggagcactgatgcccagaagggggcagttgctgcttttcgagcctctgactcagcgcgggaattccccaaacacagcaaggtggaagctcgctggtgtcctctgcaatgcctaactgccaccttgtggggtttccatactgcttctaatcattgcaagatttcttgtggatattttctgtctttccccccagaattcaataggcccttttctttctatcacactccatgcacttgaagggttaaaaagacatactgagaatcagtgtaagtgttgacagtctcaccctcactgagttctaaggcccaaatgaaagcattgagttcagctttctgggctgaagtggcctggggcaacgacctggtttcaacaacagtgtccagagttatcactgcataccctgcacctctctctccttgggggttgaagaagctgctcccatccacgtgtggctcccagtctactgatgcccaagtctggtcccggagctcaggtctgctagagtcaattgagtccaacacttctacacaatcaggctcgacagggctccctgataccggcagcaaggtggcggggtgtagggtgttacaaacttcaatggttatacggggattttcacagaccaaagtttggtacttggtgagcctggcattcgttagccaatgacgtcctttagtattcatcaccacagcacgggaggcctttatgttcaggtttcgcccaagagtcagcttatttgcttcttgtactagcagggcagttgctgccaaggccctccaacaggggggccatcctttagaaactccgtctagtggtttacagaggtaggccaccagcctcagccagggccccacagtttgggttcaaagtccagctgccatcctttctctctctgatgcatacaatggaaaaggctttgtcagatcgggtagcctcagggctggtgctgccagaagtttttcctttaactcatgaaatacttgctgttgttgggatcctcattccaaagattccccgtccccgtcccccttgtgacctcatacaaaaacttggctaatactgcaaagtttgggatccacagtctacaaaaccccacagctcctaagaattctcctacctgccttctgctcttaggctccgctagatggcaaatgacctgctttctttctgatctcgggctgcgttccgacccctgtcggatagtaaatcccaagtaacgtacctgctgtcggcagatctgagctttcttcttggacaccttctacccacagtcctccaggtgcggtgtagggcatctgttcccttggcacacccgactgccgtggggtgtcccagcagaaggtcatcaacctactggagcaacaagcagcctaggtctctgctaggaaacttctggaggtctcgatcccatgcctccccgaagatggtgggggagttcttgaacctttggggaagcccggtccaagtgtactaagtagtgacacctgactccggatcttcccactgaaaggcaaacagcttctgcctctcaggggctaatctgataggaaggaaagcgtcttttaggtccaagcaggtgaaccagctgtcctcagctggcggcaaccccaacaatgtggacgggttaggtactgttggatgtaaagtcagtgtggcttgatgaagcaagcgcaaatcctgtaccggccggtagtccttggtccgtggcttgggaacaggcaggaggggagtgttccatggagactgacaaggaacaatcattccaaacgttcttaggtgcttgagatggacctggataccttgaagggcttctctggggaccgagtcctgtttttgcctcaccggctgggccccagtcttaactggccaatcctggagggttctcttctgcccgaactcttggccagcgcttagccagagctggtcttttctctttgcccgggtcagttcagaaaagtctccattcctcctctcgggggaccataagcgtcataatgactcccattccgggtaactttagcagcaaagagccgtgctctgtgaaagaggcagtggctctcagcttgctgagcaagtcccttcctgaaaagttcaagagactgtcaggcatgtaacaaaactgatgaatgactttatgtcctcctacaggacaagtccaaggcaagcagaaagcttgctttgctgaaacccccgtggctccgatgacgtcagtagtctttttcggtaaggggacgaccggggcggttactagcgaatgttcagcaccgctatctacaagaaagttaatgtctccacccctgactgtcattctgaacagatgtcagaatggggatgcttgagcccggtctccctcagtccaagaacccttccgccaggttgagcagggccccttcctccttgtccggggcctccggctctgagtcaccttcttttcttttgagctgagggcatttgttcttccactgtcctatttctttacaatcagcacactggttacgctgcaaactctgacagccaagctgagtttctttcccagggccccctttcccttgcctctttgcgggggcccctctgattgctgcagctgacaaacaggtcggcgtgtggccgggcctgacctccattctctttgccgttttccttacggcttactgcatacctgtttacaaacacctggctagctatttctagtaattgggatggattcttccctgcaagcccagtctgtttctgcagttttcttctcatgtcttctgcactttgatggactaaagccatgtgaatcatgcgctgattttcagggctatcgggatcaaagggagtatacatatgataggcctcatacagtctctcgtagaattgtgctggactttcttcttttccctgaatgacctcagagagcttgttaacgtttgtggccttctgagctcccctcattaatccttccaagagagcttccctgtctcggtttagcctttgcatctcctctctttcatgtgggtccaactgggggtcggttcctggcaactgggtccttccatactgttcggggttttgataatcagctggtgcatgttcctctagccacttagttgctgcttggaggactctctgcctttcttcactgttaaagaggaaaatgagcaactggtgccaatcggtccaggtgtggttgtgggtctggataacagtttggagcaaatcaattagggcttgtggcttttcggtatagggcgatgtattgtttttccagttgagaaggtcgacgcaggtgaagggctggtacccaaaaacacgtctctccactacatgagcattttcatctatcccagtataccgctgctctctcaggggcatttgtgtccccgttttgggtcgtaaacgagctgccgaggaaggggtggaatggcgcaatgcgacttaccgcaattaataatctcaattattaactgacactaataattatcaatattaataacccataatataattttaaaaatcaatacggatactaatgataattaatattaaatagttatactaacaataacaatacatgattaatattgatgattatgacgcctgatattaataactgatactgatcttattctttagaaaatagtaatattagctcctaataattaatattaatattaataatctgagaactttttattagcaattacttcttaatattaatattaatatcggccattcatattcatgttaataaaaaacaaggaataattcatactaatagtatgccctaatacctcagtgggtgtacacccacctgtgatattgttcctaatgttcagggagggagagagcatgatattacgttcaatatcgcagcaggtgcacacccagccggtgatattgatccgaatataatctccagggggtggagtatgacattactcccaatatagcactgggtgtgcatccacccggtgattttgttcctaatattcatggaagaagagaatgctattactcccaacatcgtaggaagtgtacacccccgtgtgacgtggttcttaataatattccaaggcggagggggtgatatgactacacatatggcagaaagtggacacccccaaggatattgttcccacgatcctggagggaagaggatgatattgctttcagtatcacagaagttggacacgcccccactgatattgtttgtaattgcaacgtgggagaggaggatatgacacgcgatatccgagggagtagaaacacccctgtgatactgttcttaatattcagagagggagaggatgatatgactcccaatacagacggttgtacaacctctgtacgccggggtgaacactggtgggtgaaacagttcacaatctccagagcgggagacgatattactcacaatatgataaacaggctgtgagtccaccgcggatcctaaaaaccaggggggcaagaggggttagctcttcctctgcgcatggcggggcgtgcctcaccccctgcgatgggggtcctaagagccaggaggtaagatgggaaggctcttaatacccgcatcaaggggcgtgcctcacaccactgcgatgggggtcctgagagccaggggggcaagaggggctggctcttaccccaagcatagcaggacgtgactaaccccgctgcgatgggggaaactaagagccaggggggcaagagggtttggctcttacaacccgaaacggggggagtgcctcacaacctgcgatgcgggtcctaaaagccagggaggcaaggggggatgcgggagacagtggctgtcctccatctaaattgcaagaggctttcctctttgactaatccacctcggcacagaccctttacgggtctcaggctgggggacagtcaggtattccccatcccacagggccatatttcagactgttacatggggagaaaccttggacaataacctgctttcaagggtagaggtcgctgcggctttccacggtgcatagtgcccctggtttattgaaactagagaatggcaatgacttttaccaagtatactgcttgtaaacatttggttaacaaagcacatcctgcacagccctagatcccctaaacctcgattttatacaacacaggtttttgtgagctccaagttgggtcaaaggggctggggcaaagtggatgaggcaaggcaacaaatgaacaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcagggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagtcgcaagacgagctgaaaaaggaggcaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttggtttcgctgaacaattgtttctttcacgcaatccctggggggtttttgcggggggtgggggggaggaagagacaaaggaggccgaaagaaaccgatcacactggggcttgctggtggggtaggatgtgttctcgttactagtaattcctggaacagaaaacgagaaaacatatccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgagaatgcgcacagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcttggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtgactgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccttgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaagagacaaaggagtccgaaagaaaccgatcacactggggcttgctggtggggtaggatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggctctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagcagccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaaattccccaagaaaccgagactgggtcccttccagatccccgaaagcgccatccagggaggtgagctgggggccccggggaatctccaacctccgccagccgcaaccgaacttggaccaagtacgtcgccccagatgggcaggaggacaccggcccaggtgcccagcgtcgactggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttccctcagtttttattgattatgattttcattatttcagcacaaaggaatgcagtaggggagcagggtgataataaggggaaggtcaaaacaacaacaaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccagcatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacagtccggtcttttccatcccacgaggccatatttcagactgtcacatggggagaaaccttggacaataccctgctttcaagggcagaggtccctgtggctttccacggtgcattgcacccctggtttattgagactagggaatggcaatgactcctaccaaggatactgctcgtaaacatttggtaaacaaggcgcgtcctgcacagccctagatcccttaaacctcgattttatacaacacaggtttttgtgagctccaagttgggtcaaaggaaggggctgcgggaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaatgaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcaactagaaagtatccgtatccagaatgaataagatcaactctctgctcctctgacagcagaaggagcaggaccataaggaaccaaagagcgtggaaggaaacgatgtgacaggaaagctcagagaacggccacagggggtcgtcagcaggccttcgaacctgaatcatgaataattaatgaagcgcaaatcaaaggggactcgagtttcagcaggagcaatccatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccttgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaagagacaaaggagtccgaaagaaaccgatcacactggggcttgctggtggggtaggatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggctctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatccctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttccctcagtttttattgattatgattttcattatttcagcacaaaggaatgcagtaggggagcagggtgataataaggggaaggtcaaaacaacaacaaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccagcatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacagtccggtcttttccatcccacgaggccatatttcagactgtcacatggggagaaaccttggacaataccctgctttcaagggcagaggtccctgtggctttccacggtgcattgcacccctggtttattgagactagggaatggcaatgactcctaccaaggatactgctcgtaaacatttggtaaacaaggcgcgtcctgcacagccctagatcccttaaacctcgattttatacaacacaggtttttgtgagctccaagttgggtcaaaggaaggggctgcgggaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcaactagaaagtatccgtatccagaatgaataagatcaactctctgctcctctgacagcagaaggagcaggaccataaggaaccaaagagcgtggaaggaaacgatgtgacaggaaagctcagagaacggccacagggggtcgtcagcaggccttcgaacctgaatcatgaataattaatgaagcgcaaatcaaaggggactcgagtttcagcaggagcaatccatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccttgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaagagacaaaggagtccgaaagaaaccgatcacactggggcttgctggtggggtaggatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagcgctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccggggtgaagccaacccggggcccttgaacaaggataagggagagaaggaagagagaccaaggtgagcagtgggaggggttttcaccactcttagggtgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggtctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatccctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcatcgaccggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagagtttcggacgctgggaagcgtgctgtgcgaagcgctctcggggtctttcctcagcctcgaaaactgggctctggaatgcctttgtacatatgtgtgtttaatgtgttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttccctcagtttttattgattatgattttcattatttcagcacaaaggaatgcagtaggggagcagggtgataataaggggaaggtcaaaacaacaacaaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccagcatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacagtccggtcttttccatcccacgaggccatatttcagactgtcacatggggagaaaccttggacaataccctgctttcaagggcagaggtccctgtggctttccacggtgcattgcacccctggtttattgagactagggaatggcaatgactcctaccaaggatactgctcgtaaacatttggtaaacaaggcgcgtcctgcacagccctagatcccttaaacctcgattttatacaacacaggtttttgtgagctccaagttgggtcaaaggaaggggctgcgggaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcacctagaaagtatccgtatccagaatgaataagatcaactctctgctcctctgacagcagaaggagcaggaccataaggaaccaaagagcgtggaaggaaacgatgtgacaggaaagctcagagaacggccacagggggtcgtcagcaggccttcgaacctgaatcatgaataattaatgaagcgcaaatcaaaggggactcgagtttcagcaggagcaatccatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaatatacaaaggagtccgaaagaaaccgatcacactggggcttgctggtggggtaagatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggctctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatccctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttccctcagtttttattgattatgattttcattatttcagcacaaaggaatgcagtaggggagcagggtgataataaggggaaggtcaaaacaacaacaaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccagcatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacagtccggtcttttccatcccacgaggccatatttcagactgtcacatggggagaaaccttggacaataccctgctttcaagggcagaggtccctgtggctttccacggtgcattgcacccctggtttattgagactagggaatggcaatgactcctaccaaggatactgctcgtaaacatttggtaaacaaggcgcgtcctgcacagccctagatcccttaaacctcgattttatacaacacaggtttttgtgagctccaagttgggtcaaaggaaggggctgcgggaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcaactagaaagtatccgtatccagaatgaataagatcaactctctgctcctctgacagcagaaggagcaggaccataaggaaccaaagagcgtggaaggaaacgatgtgacaggaaagctcagagaacggccacagggggtcgtcagcaggccttcgaacctgaatcatgaataattaatgaagcgcaaatcaaaggggactcgagtttcagcaggagcaatccatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaagagacaaaggaggccgaaagaaaccgatcacactggggcttgctggtggggtaggatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggctctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagcagccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaaattccccaagaaaccgagactgggtcccttccagatccccgaaagcgccatccagggaggtgagctgggggccccggggaatctccaacctccgccagccgcaaccgaacttggaccaagtacgtcgccccagatgggcaggaggacaccggcccaggtgcccagcgtcgactggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttccctcagtttttattgattatgattttcattatttcagcacaaaggaatgcagtaggggagcagggtgataataaggggaaggtcaaaacaacaacaaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccagcatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctgggggacagtccggtcttttccatcccacgaggccatatttcagactgtcacatggggagaaaccttggacaataccctgctttcaagggcagaggtccctgtggctttccacggtgcattgcacccctggtttattgagactagggaatggcaatgactcctaccaaggatactgctcgtaaacatttggtaaacaaggcgcgtcctgcacagccctagatcccttaaacctcgattttatacaacacaggtttttgtgagctccaagttgggtcaaaggaaggggctgcgggaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcacctagaaagtatccgtatccagaatgaataagatcaactctctgctcctctgacagcagaaggagcaggaccataaggaaccaaagagcgtggaaggaaacgatgtgacaggaaagctcagagaacggccacagggggtcgtcagcaggccttcgaacctgaatcatgaataattaatgaagcgcaaatcaaaggggactcgagtttcagcaggagcaatccatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaagcagagtctccttgatgacactgaggcctacgtcgagatagacaaaatgtggtccaattaaaaggtgtctattttaccacattttttaaaacaaaacaaaacaaaacaacagaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagcggggctgctgcagcacctgcccatctcagcgccagcctgggaaagaaagtagacgtgtaatttcaggttagtttcgctgaacaattgtttgtttcacgcaatccctgagtggttttggcggggaggggcggggggaggaagagacaaaggagtccgaaagaaaccgatcacactggggcttgctggtggggtaggatgtgttctcgttactagtaattcttggaacagaaaacgagacaacatatccgtctccacgtgtgggagaagaccaagatgggaatgcgaaaagaaatgtactgcagcatgctgagttggtgggtaaatggaaaaaggactttggaaaaaaggggggtttgcccttcagccgtgtaagacgtcgatacgatacggcacttcttccccgtttgttcagatgaattcgtgtggtatgcgtaaaataccaggaaaataaataaagaggggctggagctaaagccaaaagatagaacaggaaagatcatcacctgctagtgcggtagagaggaaggtaacttctctgtatgaatttgtgtttggaagttgcctaatgaaatggcaagagtagcgattcaagttatcacaggaagcatcccttatccgtgacttcaagcagacctgccaaagggtggcacacgccatgccctgtgtcttcgatcattctgtccgtcaagggagatagaatcaccgtgtcttctaccggagtgaaccgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgacccactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcccatgggctttgcgagggaacatcgtacccgaactctcccggcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttaggatgctgcctcctaaggacatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagggggaaaagcgatggaatccaaatcacagtccttagttcggaagcctagagggccacctggaggatgggaaggttggcacgtgagggaaggtgcagaggcggaaagggcaccagatgtccatttctgtatcacaaaacacggaatggggctgggccccagacggggctctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggagtcttctgatcatctgagggtgagtgtcaccccgggcccctggtccttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaagatgccgtatttcctgtggctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgcctcgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatcgctcagctgccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagcagccccgagggtggctgccgagaagttccccaggctgcctccaaaacccacggcctgctccaggccgccagaccccaggcacaagacaaacgtcctgcggtgacctcgcagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcacaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggaaccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagttcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctccggaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgtgttttgaagtgaataaaattctcaagaagatgacatattgtcttttgactctcattccgtgtttgtgtgtaactgattttccaagtgaaggggtggcctgcccctccacacctgtgggtgtttctagtcgggtgggatgagagacggagaaaagaaataagacacagagacaaagtatagggagacaacagtgggtccaggggaccggcactcagcacacctaggacctgcaccggcaccggcctctgagttcccgcagtttttattgattgtgattttcattatttcagcacaaaggaatgcagtaggggagcagggtgataataaggggaaggtcaacaaaaacaacacaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttcgccgagctcagagttgaacaaatgtacgatcgggctttacaccgagacattcagttcccaggggcaagcaggagacagtggccttcctccatctgaactgcaagaggcgttcctctttgactaatccacctcagcacagacccattgcgggtgtcaggctaggggacattcaggactttcccatcccacgaggccatatttcagactgtcacatggggagaaaccttggacaataccctgctttcaagggcagaggtccctgtggctttccacggtgcattgcacccctggtttattgagactagagaatggcaatgacttctaccaagtatactgctcgtaaacatttggttaacaaggcgcgtcctgcacagccctagatcccttaaacctcgattttatacaacacaggtttttgtgagctccaagttgggtcaaaggaaggggctgcggcaaggcaacaaatgaacaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggcagagactcactgaaagatctaggcggggatatcccatcatgcacaggctctctccattctctgacctgggaacaactctcagcaggattccacatctaggaggcctcggaactcagcgggattttctgagacacaccaactggctgctccctctccgccgctgttgagggtcgttatcttgattatccagatcacctagaaagtatccgtatccagaatgaataagatcaactctctgctcctctgacagcagaaggagcaggaccgtaaggaaccaaagagcgtggaaggaaacgatgtgacaggaaagctcagagaacggccacagggggtcgtcagcaggccttccaacctgaatcatgaataattaatgaagcgcaaatcaaaggggactcgagtttcagcaggagcaattcatccaacgggagatcgccggagggccaacaagattgagtgactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattacagcctcacaggcgtccgggagacttttcaggcataatgcctggagtcgcaagaggagctgaaaaaggagccaggcactgaaggacaaagcgttgttgactttcctcatctgtgtttcccagtgcggtccaattcacggttgtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagatagacaaaatgtggtccaattaaaaggtgtctattttaccacattttttaaaacaaaacaaaacaaaacaacaaaaaagatggaaaagaagacaggggtacaggcaccagtgttacatgtctgacggggaacatctattgttcaaagcttgcagctgtacaagtaggttttagaatgtctgtcagcagtggacatgatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcggaggtccctctctgccccttcctccgtcgtcctggatgctgcatcgcttccagccgggctgctgcagcacctgcccatctcagcgccagcctgggaatgaaagtagacgtgtaatttcaggttagtttcgctgaacaattgtttgtttcacgcaatccctgaggggtatttgcggggggtgtgggggaggaagagacaaaggaggccgaaagaaaccgatcacactggggcttgctggtggggtaggatgtgttctcgttactagtaattcttggaacagaaaacgagacaacatatccgtctccacgtgtgggagaagaccaagatgggaatgggaaaagaaatgtactgcagcatgctgaattggtgggtaaatggaaaaaagactttggaaaaaaggggggtttgcccttcagccgtgtaagacgtcgatacgatacggcacttcttccccgtttgttcagatgaattcgtgtggtgtgcgtaaaataccaggaaaataaataaagaggggctggagctaaagctaaaagatagaacaggaaagatcctcacctgctagtgcggtagagaggaaggtaacttctctgtatgaatttgtgcttggaagttgcctaatgaaatggcaagagtagcgattcaagttgtcacaggaagcatcccttatccgtgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccaaatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggaggcggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttcgagtcctgtgtagccacgtttggctgcgttgttgacatcggcttcaccatcgtgccccttggaaccttgagtccttcctttcagagttcctccgtcacaagggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccacgtgccccatgaagtgctggaaggcagccctggttccagcgaccttggggaaaaaggaagggaaggaaaacctgaaaccatggaagccccggggtgaagccaacccggggcccttgaacaaggataagggagagaaggaagagagaccaaggtgagcagtgggaggggttttcaccactcttagggtgctgcctcctaaggagatggtgtctctgcacctgcacaccgtgtgcctttccgtctccgggccagggaaggagcgctgcagagaaataggccggagctccgtgtcctccggggttccacacccaggagctccttgggctctgggagattcagggacggggagaggcgggggcgcttcgtgcaggttccccacgacagcgggaaaagcgatggaatccaaatcacagtccttagtcgggaagcctagagggccacctggaggatgggaaggttggcacgtgagggaaggtgcagaggcggaaagggcaccagatgtccatttctgtatcacaaaacacggaatggggctgggccccagacggggttctccctgtctcctggggaaaaccagggggcaccgcctgacctttttctgttctgcaggcaacaagacccgcagaggaaggctctcctccacatgttttccgggaaacctccagagaagccgctgccgaatggaaaaggatccacggaatcttctgagcatctgagggtgagtgtcaccccgggcccctggtccttttctcctctaggtcaccctggttgatttcctttcagcttcccgtctgtgggaggaaatcggggaacccctctttcttgccttcttggggtcagggactccacaatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggctaaacccaggaacatgcatgtgttcagagaagacgtcccgagtacccttgagccaccaacctgcctcgggaagggcattagtccgttccacttcatggaaggctgagtggaggcgctttgatccagttaatgcccaagacgcgatcttttgaacaatggtgtgcttagatcagctacacatagctcgagagcgcacctttcatgtgtcttgtcctgatcagcactcaggtggagggatctgtccctacttccaaggaccgcctgtcgatactgtactaagaatttcatggcgtgtgcaccttgtctttggatatgtttgattttcacgttggctccatgccgtggaacttctaacctgtgttgtttcctctctttcaggttgcaagcgggccaatgccggtccacacaaccagtaagaggccgcgcgtggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatccctcagcctgcattcaggcaccagggccccgagcctctcctcgtggtgaagccgacacacagcagccctgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccgggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgactggcagcctccgcacagcacaccttgcctgcctactgcccaggcctgcaccatgtcccatcacccagcggccggccatgatggggcccagcctctcagagtgctcttccggagactggaaaacggacgctggagctccagcctcctggccgccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctgtctagatgactgaataagggaaaagttagggaaccctgagaggtgcagcccttccgctgtgccccgccctgagagcagtgtttcggacgctgggaagcgtgctgtgcgaagcgctctcggggtctttcctcagcctcgaaaactgggctctggaatgcctttgtacatatgtgtgtttaatgtgttttgaagtgaataaaattctcaaaaagatgacatattgtcttttgactctcattccgtgtttgtgtgtaactgattttccaagtgaaggggtggcccgcccctccacacctgtgggtgtttctagtcgggtgggatgagagacggagaaaagaaatcagacacagagacaaagtatagggagacaacagtgggtccaggggaccggcactcagcacaccaaggacctgcaccggcaccggcctctgagttcccgcagtttttattgattatgatgttcattatttcagcacaaaggaatgtagtaggggagcagggtgataataaggggaaggtcaacaaaaaaaaaaaaaaaaaaaaaaaaaaacacgtgagcaaaagaatccatatcattattaagttcaagggaaggtactatgcctggacgtgcacgtaggccagatttatgtttctctccacccaaacatctcagcggagtaaagaataacaaggcagcattactgccaacatgtctcgcctcccgccgcagggctgcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcgggctgggggacagtcaggtctttcccatcccacgaggccatatttcagactgtcacatggggagaaaccttggacaataccctgctttcaagggcagaggtccctgtggctttccacggtgcattgcactcctggtttattgagactagagaatggcaatgacttctaccaagtatactgctcttaaacatttggttaacaaggcgcgtcctgcacagccctagatcccttaaacctcgattttctacaacacaggttttttgtgagctccaagttgggtcaaaggaaggggctgcagcaaagctacaaatgatcaacatctcagcaaagcaattgtttaaactacaggtctttttcaaaatggagtctcttatgtcttccccttctacatagacacagtgacagtctgatctctctttctttaccctacatccacgggcttgaacatttcttgacttgttggcaatccaaatcgttacgtctccgaaacagagttgactgatgggaccgcaggtctgggcaggactttgacttcctatacatccacaggagcaagaaaacctcagccccactctaccaacacgcacctagtaaaattccgccaaccgaatctcacgcacgctaacacgtggggagcgttgcttgcaccacgagtccccatttggctcaaccgccgatgccaagtgtgtggttccagttgcgacggccccctgtgaagtggcttccggatgtgcgaatgaaccaggcagcgtttcactggccaaatagaccccagcaaaactgaagttaactcccacatttgggatgtacttcagaggtaaaacattcatcccgtcttctttccggatgtctgacaccatggttctccccctgatcctaagagtagctgaggtagagactcactgaaagatctaggcagggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagaaggagcaggaccataaggaaccaaagagcgtggaaggaaacgatgtgacaggaaagctcagagaaccgccacagggggtcgtcagcaggccttccaacctgaatcatgaataattaatgaagcgcaaatcaaaggggactcgagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaatgccccagtgtgctggttcatcattccgactcctgcctgtctcttccggttcagggaacatagaccctcacttgtgttatccagttgtcgttctttttttagatacttatgcagtgatacacaactgtaactattttttaaatttatatttaggcctctcctcataagatacattaatcaagagcctttccattgtgtttcaaaacacagtagcatctcactctacacaccggacatgcctggttactgttttatccaacatgtttgaaatcagcattgtgattgcctttttttttctacacgaaggagatagaaacttgtctgtcctcctcaaagttatggccctgcctttataaaaaaaatgctgcccaaatcatgaaatttagtgtacaggtatatgaaatacaaaccaaaaattgaaaacaaaacttaggaatggcaagtggtaatgtaaacttgatgagccagagcagaagcgtgtctcacttggaagcaatcacagcagtcaccactatttcatcctataatttcagtatttattgaaaagtattggcctggggagtgtggggaacctgaacaaagacaaggactgggtcacagcacggagaaaatggtgaaaatctcagggcatacatacagtgtcaagcttaggaattattatctatacatcagaccaatgactacatggacaccagcaatcaaggggctgtgttagccctgggagtgagcagagttcttcaggtgaattttcacgccactgaaagcatgctgaaagcagaaccctcacgttgaggagtaagggatttgattgagtgtggttgcatttaagaggttgaatatggaagagaaattctaagggacactgtgtgccaagtgaaatgggagcactttatttacacaccttgcagttcttcgtctccctgcagcatctgggatcctctgctagtgagcacaatggatcatgatgggaaacagagaaggggaagcaagaggttcctggaactactctccctccacattttagggcatgcactgactaaggatttggccaatctctgatctatcaatgtaagtggtggatcttggctacatcccttcttgaaaacacatcttcgtgctctggttggagaactatggtgaaccctgtggcagacctgagtgctggacttggtgaagggtgcataggtctgagggaggagttgggcaaagtctccatcctatacaggctgaagctgagattggctggtctagcgaatcccactggactaggtgtggttggtaaagggtagggcacagaggagaaagtatgcaatgcgcagtaggattattgaaagagaagcgctgagccaagcaacatggttttcttcggatctcatcaagggctggtgacatacgggttctgcctccccctcttctgtaggtgagcgcggcacattgtctctttcatgtctgaggtgtctctgtcttgaacatggaactccaaggtgaagtcatccacagagtgctagatgtaatcgatctgcagagggaactgcaggccatccagtgacctcaggacatgctcaggcacaaccacaaatacgctgttacccagggtcagggcagggctgtctgtggggacaggatgaggacatactcttccagtctcagtgtgagttctgtcccttgttccgggaccacgatgatgaacgtctctgtgctggaattctgctgctgctgtggaacgacagccctcagtccactgccttcaaaaaagactgcaaatgatgctcctggggagggagctggagcagcttcaccctctacaactttaaaatacaaatttcctcctagaagtggcagtcatgctgaccctgctgaatgcaccaccactggatgtgtcttgtggcctggagattatgcaacatagtccaatctttgctatccatgaacatagggagttacctggggtgattccaggcctggaatgaattcatgtgaggaattctttgaagtaagggtgtttctgcatctgtggtgagaccacagtgagggaggttaaggctccccacctttttttcttctttctttctttccagacacaggagataatcaacaaagaccaggctcccttttaaatccaataagaaacattttacaacctactccctctcaagtctactatctgaaggttcctctgcacagtaaaacttggcctccccacctctttatcttaacctaaacatttcctttcaatagatccctggtcttagataaactcatccaattatcaaccagataatttttaaatctatctataagctggaagcccccctccttcaagttgtcccacttttctggatcaaatcaacgtatttcttaaatgcacttagttgaagtcatgtctccctaaaatgcataaaaccaagctgcaccctgatcaccttggacacacgttctcagaacctcctgagggctgggtcacacgacatggtcaatcatatttggctcagaataaatatctccaaatattttgcagagtatgactcttttcctcaacaaggtcatgatgattagggtcaaaattcaccgatatgaaggacagccccaatttcttgactcagagaaataaagcaagagaaaacacatggaggaggaggaggaggaggaggagaagaacctggagctcccgcctgcccctgggtgagtcctggaggtggaaggagaggtacttgatcctgagttggcccctgctccacctgaaacagaaccctggagtgccactccctgaatgcggcccagctctacccaggttagacactcccttgccctagagcctgggtcctccctggcccccgctaccactgcttcctcagagcccaggcccagtgcaccacatctgcctctgcacggctctgggagggctgcaccaaggacaatctagtctcagaggggacttcctggacacaggcgggtcctgacaccctgagggaacagaggagaatggccttcacaggggctgctgtcttggggctcacagaagcggcctctccagcgaccagactcagaacctacccagaggcccaggctggtgaggatgccctggctgggcctttcatgtggatgaaggcagttcccacctcagccaacgtctaaaaccccgaggagaatcaaacctgaaagagtccctgtcctccttcccagaggggaaacgcagttcctgaaacctcagtagaagagaaaatgctgtgagggttcaagggaccaaggacgcccttcccaggccagcaaggccagagtaggaggaagctgcacccacctccaggggacatgtgaggttttagaggctcaggcaagtcaagggcaaacgccctgtactccccgcagggtcatgagcactccccacctactggagttgggctccagaaggccaggacattatccctgcatctcccctgcctccaggactcaggcctgagctcccaggttggccaggaaaagctagtggtagctctagctggccatggacatacaggctgggacatgcaggccaacaaagaggtgctgggccctcaagagaacttctagacttcctagacactccagagacacagagacgtccaggcaggacagggagagcctggaagcagctgtgagcaagtgcaggtgcccgtcccaacacacagagctaagctctgttcaaccatttgctaagccagacccatcccagggcccagaggtgcaaacagtgaccccactcaggacttggaaggaggagcacaggaaaagccccaaattggccaaaaaaactgtcagaaatgtggcagttatttcataagtacatgaataataaacccaaacaatggaaaacaaaactaaacaaaggcaaatgtgaatggaaacgtgatgagtgagagcaggagagtgtctcagttggaagcaagcacagcagtcaccactacttcattcaatgacgtcaagatttattcaaaagcattggcctggggagtgtagggaacctggactaagacaaggaatggggcacagcttggagaaaaaggggagagtctcagggcagaaatagagcatcagccttaggaattatttattgtggcatcagaccaatgactacaaggacatcagcatgcaaggggcggtgttagcccccgggagtgagcagctgtcttcagatgaactttcagaccacgtcatgctggaagcagaactctcacatggagcagtcagggatttgattgagtgtggttggatgtatgtgcttaaataggaagagaaagtctaagggacagtgtgtgtgaagtgaaatgtgaatgttttatttgaactccctgcagttctccccctccctgcagcatctgggaccctccgctgttgaagacagtggttgatgatggggaacagcaaagggcaagcaagtggtcaaattactttctctccacatttcagagaatgcactgactaaggatctggacaatctctgacctatcaatgcagggggtggctcttgggttaaatcacttcctaaagagacatctccgtgccctgctgggaggcctatggtgaaccctgtgatagacctggggaccaggacttggtgaagggggcataggtctgagggaggaggtgcacaagagctccataccatgcaggctgaaactggagtcggctggtctagggcgtcccacaggactaggtgtgggtggtagagggtagcattgggggaaggctgcccgacagcgtggaatgcacaatggggttactaggaaagaagggctgatcccagccatgtggtttgcttggggtatcatcaagggctgctgatacaggggtgctgccttcccttcttctgcaggtgaaaaaggcacattctctcttctcatgtctgagatgtctccatcttgagcatggaactccaagctgaagtcatcaacggaaggtatgatgtactggatctgcacaggggactgcaggccatcttctgacctcaggacatgctcagggacaatcacaaggactgtgttctccagggtcagctgcagcactgtctctggggccaagatgaggatgacctcttccaggctcaacctcacttctgtcccttgttccaggactatcatgagctcctcagtgccagaatcctgctgattctgtggaaagacagtcctcagtattctgccctccaaaaaggctgcaaatgatgctcatggggagggagatgccaggagcttcaccctttacaactttaaaatacaaactccctcccagaattggtgctcatgccaatccacctaaatatacatccactggatgtcccttgaacctgaagattgtgcagcactgtccaatctttgctatgcaaggacacaggaacttacctggggaagttccagggactggtatgaattcaggtgtggagctcctgaaattgagggtttttttgcacctgcagagagaccacagtgagggaggttaaggctctcttccagcaagagtctcttgcatttcagaatgtgaccttcagaaatccaccacccagcactggccagcctcaggacaccagcccccaacagtcaagcacgactttccactcaccctgcagaaagcaccctctccatttatggtatcatgagacatgacactgacttccaggcatgggaatcttaaaaaatattagggaaagtgccttacctgtactgggaccctgctccacttggcgacgtttgggtggattcatttgtgtggtagccaaactgcaggacagaaagggacccatcaatcttccacatagtgacacaaagtccaattctcacaagccccaaacttcattagtcatccggcacacattgctgctgtggcccaaaatcacatgcacttgtgttcagctccaaatcctacctgcatccagaaagtcctaacactcatatcccaccctctccttttctagaggcttttcctatcggtgcatgtgtgtgataagacatggcgatcacaggaaacagtttgctttttcaggagctcatccacatgagaaggagggacatcaaatttggcccgaggactttaggagaagatgctgattttccgggtatctaacccctgtgtctatgcagttacagtgtgaatggagtgataaatgacatgaaatgttccattttctagtgagcacaaggaaaaaatttagatcatgcccacagtttacctgtctccacacaagaggcaacttctgtttacccagaggacagagattaacaatgggaagaaacatgagatgagccccctgacaggctgcagaaaccccccatgctggctgcatcctgtggcctccactgtgggtctcatgtctccccaatgtgttctaaatttataacattcaatgtcatggcaggccagggtgtcttctctgccctagtttggccctttagcatacattcacacacacacacacacatacagtcacacacagtcacatgtcaacctcctggcaacccaaagtagccacatactccaacatacctggtctctccttcattgtcattctgcggttctgtctgggaatctctggggcttcttaagcgccggtaaccatacatggtaaaagttctctggacttgcttgtgtcaaaaaaatctcaatctttggcctattttctgtaaatctatatagttcgtgccttgatcttttactctacctggagaaaaattatcagcctctagcacagcacagccagagcatggaagagtgtgtcctggcctgggaccggtcaaatggtgctttggtagagtgagctcttggggaaatcctccaagggtcttataagaggtggagccatgggatttgtcaaaatggatgaatgtgattggctagtggtgctgattaaacaacatgaagggccagcatgggagtggttttatcaaaactcagtcaatatgagtgtgacccagtcagaattagcctaattcaatcaaaattaattcaagatctctactctgattcaccatataattgtgacataaaataacagtattttaaactagcaatatttactttctattgtagtctgttcattaatttggtaggacagttattttctgtaaagttcatgtgtacgtcgtttcttagtaaacataaaggattgggtctaggaaactttaaatatgccacaatttgtatatactcaagtcccttgtataaaacggcgtagaatttgaatataacataatcacattaatttatataatttaaatgatctctagattacttacaatacttaatgcaatgcccagacgtcacgtcatttatgtgaactcaaaaagaatgtgatgcatggaaaatttaaagtttctctgaagaaacttgtgcaaatcttttgtgaatattttctattcaagattagttggatccatgaatatggaacctatggatgtggagggctgacagtatttttaaataaaaaaaaatacgttattttaagtgaattaagttttaaaatgaatctcctggggaaagttatccaaacagaagaagcgaatactataagacaagctggggaaaatacaaaaagaacctttacttaatttctaatatatcactgtgtattaatctgtctgttaatttatttcttgcctgtatccccgctggactaatttcagaattgtaatgcaagttttgctttcaacattacttattaattacaaatccatcattcttattggcaaagtcacctaaacttcttgcaggtggccagacaccatatgcctgaactcagaattagtcattttaagattaaaaattatttgacagtataaagaataatagatggtattgggggaaaacagtaatccagtaatcactagaactgaactagaaggaaaatctgtgagggtgcaccattactgagcgtgccatctctaacaggcccctgagctcagggcttcatcctctctctagaacttgtataaatttgtttgtggattctctttgcatttagctgataatttcatcagttttattaggtgaagtatagaccctgtttcccttaaatgttaaaaaaaaattgaatctaattagcagatgccttttgcactgaagctttcttctccagttagataaatcatttagatgaataaaaggaaaacaggaagattcctttaattttgccaatgtcttaaaagcctccaaggggaacattagtgcctttatccagagaactctctgctttggggattttgataatttctgaggagaacagcaggtaattagctgaatatcagctgcagttataaaattggattaattgcctacattctttctggctgcggggttcaggttgagatattcaagaaatagcctctattgatgattctggagtatgtatattttacagtcaagaaagagaaaggctcctcatggtgagtttctgtgtgtcacgtctagctgaaaacctatggactgcaaaccagtacaagaataaaaatatgagggacgtgccaaatatatattctacctttataatcgctttgattataaaccaaatgttttaatagataaattaataaatttgcagcataaatgtctcaggatatatcctgcagcacagaataataacttatttttgaagaaatatttaagcaatatgttttcatttggggtagaaactatttttcacaaaagtgtagctttccccttgcatgtgtaatgaaaatcacttttaaatctgcagtgctagggtaaaattaaagacgtggctcttgccgttttaatagcaacaattaaaggatgcattagtgcccctccctttcattgtctcactatttttcagtgaatttggcactgtaggaaagatgagcccctcacaatgtggaaatgcagggatgcagagtgcggggtttccctgcaggggcccctttctcgcgagctgcgcgacagtgcgccgccgtgccccggccacatactccttcctctgcagggtccccgtattctgtagattttcctcacaattcttcttgtgtttctcctcataatgaatcctgacagaggttgcgaggaaggcacattacggcctgctatggttatcaatgaaaatccctaaggaatacgtagatttgtaaaataattcttgctaatatatcccaacagacagtgcagaagaaaacacgtaggaacagcccagaacattaagtctttagtgctgtttcagaaaaatatccgggagacgcgcagggaatctcactcctcagcaggtagggctgtgaacagcagcgttttccttaagatggatgcagccccatttgccccaaagccagggcggcgcctcctcctccctggcctgaggaagggaagttcccttcttccttggcgatctggccccgcttccgcaagcagaatgcgcatgcgccccgcacgaccagaaagcgagttccattgccctctgccggctatgggcttgcagcgcgggactcttggccttcactgtttagcggttgacctgcgtctgtatcgctgaaattccggttttatcagtaccttccttttggaagatcaaatgcaaatggagcacggtatcttttttctttttctttttttttttatgaaagagggtggaaataaagaagcaaagtccaaagaccgtataaaatagtctgttgattccctgtatgtggaggaaagaggagctcgaataagagaaacattctgtgtgatgctttaatgccagagatctgccactatgcatttgtcaaatacaatacaattttacagcacaaatagtacatcttagtgggtcaggattacagcaaatgacatctaaaatttggagaacattacatatttaattaaataggtcaaagtataaataatgtgaggcctgcctggacacagcctctgcctgtccttccagattgtcatgggcttgaattgatgtctcctcatcctcacacaggaattgacataaaccctggctttaacgtaaaaacagttgggcagatttgtaaacattatgatgtttcactttcacccatgaattagccaatttaattggcctcagtaaagtctatgattttgggattgtgcagtttggtaaaagctcaaagtcctctcagtatatttcctgggaccacttctccttgatatttagattcagtactgagatttgttgaagcacaatatgtatccaagcccgagtcaaagcagaggatgcctgctggtcagaagattcattttgcttgtggaaaagtccattgcatttgatataaaagggcttgcatggtgactgagaagttagggtgttttagtttgctggtgctttatctgctaggctatagtaaggggagcaatgctgtgtccttgtctgtgtcataacgcaattactcacttgaatgaaaagtgggatgtcatgagatgaattccttttccctctttgggaggctttaggaacaaaatctcaagagttttctgagggatacaagagcagggctgcctgactctctgccccgggagctgttcatgggcagagacgagggctggggtcatccaatggtttatacaaggtgtctttgatattactcccatttccctgctaaatctgtgtaatggctcactgagaaacccggcatgaagatccctgttttgacaactccagggatggatggagacaaatatttttgttggaagttagaattaggggacatgggctgtgcggcaaaaataaaaaactcttgaagaaggcagggactcgaagaaaggggtggaatttctgcccacatgccaaagagtgcagaaggaattctaagtgttagagcagcatcagtaaaactagatcttgtacaacatattacatttttcaggaacaggctatattgtttcaatatttgcaagtattgttctcttaaaaaacttgaggagttgcttagacctctggagagaaaaattgagacatgtaagagggcaggagtgacacagtggtgacacactctggagtcctgcctacaagcagcaccctttgacccactccacaaaagctctattccacagctcaattcctccttaaaaaaaaggtgagaaaaaaatctaaaacttaggagaaaacaaggagaatgacccactttcaagcacttcttagattttacgacaactctactagccagactttatgtaaaatggaagtaacgtggtctttgtgcacatttaaaaaaaaaaaaaaaaaaaaaaaaagccctaaggtcgacctgcaagttatagatttcctaaggctctttttctctcttttcttttctgcctgctttatatcagctgttacattatgactgagataaaagccactgtttggatataacagggttttgtttgtctgtttgttcgtttttcaagccagtttcatatcattcctaaagttctcaaccaaaagctacaggattttcttttctgtgcaaatatgtgcatgtatatatttaaaaggcttttatgatttctataattttatgttatgtagcagttacatccattttaatttctgtctagcacaacagactatttcgctgtgttcctcagatgtaagtttcctatctgattttcacctatgaattgtttcctttgatatgcagagtaaggctatttagctgacagctacctaaggtagtcaaacaggttatcaagaatttgaaaacctaagacaggaaaaaataggatcttatgaatctataagatgtacatctattggcatgcctaatacatctatgtatttatgtgttgtgtacacaatgtttcactattaaaaatatatacaagagctctaattggctttaaaaataaaagcacataaatcagatacttaatcaaataaaagactacacaaatgctttttaaggtcacttgacttaaaatatttaataaatgagctggctttaaaattatgggtaaagtaaaattagaaatgtcgtaaaaattgttagcatttttgttttgtgtttattgatcaagtaattccatgcttaatcctgcagaataatataagattaaccataagggttataaaattatgaaagccagaccaagacaaaatgatctttgcttgtgtaattttagacaagaaagacatggaatattcttttaatgaaatcctaaattatttgtaaaaatactcttatatttaactttaggtttcctatgtaagtaaacacctaaaatgcacagctataaaaaagggtaacagggaaataacttacagaaggactgttacagttttggtcaataatctaggtaaactattgaataatgtaatcagggaaatgtgatggaataaatgcttgtaaacaaacttgtcatataatttaggatctaaggttattcataaatattgagtatacaggtaattcaaaacttaaaaattataaaaaatttttaagtgttcttattaaaatgtaaatatctttgtgtaactgacagcctacttaaatgttatgtataaaaagaaccagaaaaaaagaaatgtaaaaaaatttaaagtggtacctttttatagagaagggataaaggaaaataattttatatcagaaagaatcttgtgtagtaaatttttgccctagaataaaatgactgggtcattcaagaaagaggaatatttaggaaaaaacagaaagtctaaacatgttttgagtggtctatgtaagtcataacagggttagtaaaaatatatttttttaaaggggttgtataattcagttggctaccattaaaaaggaattataatagtctttctagggatggatcttcgatatttaaaaatatacactaatgtaaaactgaaataattggttaaaacaagatttttattaaaaatattaacttattactaatgcaaaaagttattaaattttaaattctagaatctgtctctttgaaattcttcagataaaataggtcaaaacttcagctcttcctctttgaaagggccatggatgatagctctctccttcaccttttgttggctcctgtaacttttattaattatctaaagtaagaaagggaatttttttaaaaaaacagtcaaatgaaatatcctttggacctgcctttttattccgcatgagtgttatatctctatctttatatgtgtcatgtggaagtggtatttaactcccaaactacatgaaagagctctagacaagtaacttttcttaaagaaatatagctgcttgttagactggtacaagctatctcaaatgcccttttaattttcataaccttaagaatctttggtaaaattaatgtggtaaattccatctcaaaactctccagtaatttaaaagcttcaagtcatgttaaaatctcaggttaggttatttttcactggaaatttggattgctgaaagttaaaatagcaagagcataaaatttgtttttggtgaattttataaagcataaaaatgttgactttgcttaaaaaagaaaatatatttttcctctagctagaaaactatttaagagttgctttaaaatgaaaggaaaaattatacggatataactaaataaaaagagtaattaagctagggcaacaaaagttaactctgagacccgtggctaccaaaatgatagtcaatcaatgtgggggaagagcaaaactaactatttagaaccagagggtatactgtaaagaattgttccattttgtagtttagtatcatcagcttctttaaaaaatccttactatgatggattgagaaaaaacactttaaggacaagattcttaattttaaatgttacacgatttaagagcttgtttgggttaatgcaggacccacagttcactattgaacaaccactaacatgtgatccaaatacccaggaggttattcctaagagaataatcatcataatatacccagaaaatgccaccataaagtctgttttctctgagtaggggactacctaactctcccaataaaataccaagtgaaacaccccagatggagcagttaatatgcttcttatgtgaaccatgttggactggcttaataatgactgggatatgctcccaccaaactgtctgttacccaggttatgttaaatttgggtgctaagagggccccttttacatggatgctcctcccacaaaatcatgagagtgtttgaggagtcgtatcaaatttgctgccccttagaggtcttacagatgcaactccctgctgagaaaccaaaccctttttcaatagaaaaggtaaaatgatttgggggtattaaaaaaaaattctgggaccagaacatataaacatacaggttaatagagttatgaaatttaaaatgtttaaacaggttttatgtaaggtagttgtaacctcctttactacctgggagaggtttcccctttctagtagtataaaactgaaggcatataaatctgctcttttgagaaatgttaattggacatgccaaatgggaactagtaagactgcctaagcccacaaagtatagggtagaagctggagtgctagtcgggacaaatcctgcacttcatagccctttgtgtaacatttattggggctgatggcaaaaaaaaaaaaaaactgtgagttcttcctgatgacaaagatagaacaagggaatttctagctcagggacatttagtaccttactatggaatgctaactgaaccaacttctatgatagtggaaataatgttgccccaaaagagtttcgtgataaaataaaaatggtttacatagaatcttgctacatggggatataaggaggagatactaataagcaggcagcctcattcctaggactaattctaactctgtgaggagctgctagattgcatagtgcctgatagacagctctcaggagcggtttggcttgtgcatgacatttccaagatgataaacaaacatcttgtgtgaaagccactgctcttgttaaaggagggtccagacaatctttttctttaattcattttgatgaagtttgtttttgtaagcaaattatctttctgagttctccaaaattcagatcctaattttatgacaatatggttgtttgcataagtttcaataagagtctttaaaacaattagagacttgaactaaagtggtatatttttaggtaaggtgccagcaaagccaacttaaaatgaatctatgtggccaatcaattcttgctgcattttaagcaaataatccggccaaccatgataagactaaaacttacttggcacacaaactggtcttactataatctctaaaaaaaatgcagatagaacaattgtttaaaaggaaaagcttaaggattagtactagatttcagtcctaactctttttaagtgcagattaaatcattatttctttgctataataatcctctagagagtaccagatcataatttatctccatatttttagctggttccctaatgaagtaggttcctttttccattctgacacacaaataatcttttgattgtgaaactataaatgttatttacctctccttgttttacttccaaggaaaccaaaattacggtattctgaagactagagatatgaatccccctcagctgacatcccactgggttcagatctgtatttcaccgcgaatcttctgatgctaaaactatacaagcaccctctctctaggctcagggactgtcttggaagaggcaggcacatgagattgtaagagctagttttgggcatgaacttaggtccatgtcaaactctccaaatcaaggaggggtacaaagatggtacagccggcaaaacaagggacatttccttctagactatagtgtgtcacttttgcatccaccccaaccataaacaattttctgcttctcatagatttaaaagaaaatatttactgataggataaagatgccttatgacaaagcctcttggtataatactcccaagtataaattgcacatatagtttcaaattgtgctaatgccattagtatacaatggcaacagcaatcctgatgaatccagcaaaattcgccacccagaaattaaaacttgacctcactggaaaagttggagctggcctaggtatattggtgtaagctgagttcatagctaacgaggagaggcatctcttagagaaaagttttctgtcaaaaatagcccacatagaaggaatgttattccaggaagatggaaaaggatgggaagctcctttaaaaaataatgcaacactcatcaaatggataggagaaaccaaacaaaacataaaaacatactctcaaacccgaaggtggcaatgagcatgttctgtaacccaacaggggctcatgtctatttcattacaaacacaatctaaggtggctatgaagcaatggcctatactcatctgtgccgaggcacaatccaaacacctgtggaaaatacacggccccccaaacatatggaaaatttcggatggtaaatgtgaccttaaacatggtattctcagagcataggcaccaaagttaaatgaggctcaaaggtattctgtggttcaactggcaggcattgtaaacaatacagaaatactcccctggggaaataggtggactatttcagctcatgataacacatggcgtcccatctccttttcagattgtgaaaacagaaaaggggaatggttatgccctcagtccacttagaaccctaattttccccaacttagcccctaatatccactcccatagcacataacatttgttatatgggaaagggccatttctgtgggaaaggacaacaaaatgaaagtatagaatcatatgacttctcctttaaagaacattgttttctctcccaaacacataccagtatatagtgcaatacaagtggtgtgaaaaataggtgtgtctactgttaacaaatcctgtaacaatttagatatagaacaccaggcatttgttgcacttgatttataccctcgtcaggatgttatacctatggagaccaattggcccgaagtaaacgaagctgcacccttactaccttgggcacatgttctgaggacctcctgagggctcttcaatatattgcagagtttgactgctttactcaacaaggtactggggattagggtagaaatacaccgatgtgaaggacggcgccatttctcaactcacagaaataaaagaagagaaaacacctggagaaggaggaggagaagggggaggggaaaggcgagaggagggggaagggaaggggaggggaggagtggaggaggaggaggaggaggagcagctgctgagcctggagctcccgccagccccggggtgagtccttgaggtggaagaagagggacttggtcctgagcctgccccggatccacccgcaccagaaccctagaatcccagtttctggatgggacccagtcccacccaggccagacactcccttgacccggagcccgggccctgcctggcctctgctgccacctctcatgacagagtccagggcccccgcgccacctccgcatcagcagggctctgggagggcggggccaaagacgcccaatgggacttcccgtccgtagggggatcctgacgccctaagggcgcagaaaggcgccccctgcactggggcggccatcttcgctctcgcagaggaaggggcctctccagcgcccagactcaaaacctccccggaggcccgggctggtgaggacgccctggctgggcctctcatgtggacgaaggctgcttccgccccagccgagatacaaaactctgaggagaatcaaacctgaaaaggtgcctgtcctccttcccagaggggaaaggcagttcctgaaacctcagtagaagagaaaacgctgtgagggctcgggggaccaaggacactcttcccaggccagcaaggccagagtaggagaaagctgcacccacctccagggaacatgtgaggttttagagggtcaggcaagtcaagggcaaacgccccgtactccccccggggacatgagcactccccacctactggggttgggctcagggaggccaggacattatccccgcatctcccctgcctccaggacccaggttgactaggaaaaggtggtggtagctctagctggccatggatgcacaggctgggacatgcaggccaacaaagaggtgctgggccctcaaggggactgctagatttcctagacactccagagacacagggacacccaggcaggacagggagagcctgggagcagctgtgaacaagcgcaggtgcccatccgaacacacagagccaagctctgttcaatcacttgctaagccagacccatcccagggcccagaggtgcaaacagtgaccccactcaggacttggaaggaggagcacaggaaaagccccaaattggccaaaaaaactgtcagaaatgtggcagttatttcataagcacgtgaataataaacccaaacaatggaaaacaaaactaaacaaaggcaagtgtgaatggaaacgtgatgagtgagagcaggagactgtctcagttggaagcaagcacagcagtcaccactacttcattcaatgacgtcaagatttattcaaaagcattggcctggggagtgtagggaacctggactaaaacaaggaatggggcacagcttggagaaaaaggggagagtctcagggcagaaatagagcaccagccttaggaattatttattgtggcatcagaccaatgactacaaggacatcagcatgcaaggggcggtgttagccctgggagtgagcagctgtcttcagatgaattttcaggccacatcatgctggaagcagaactctcacatggagcagtcagggattcgattgagtgtggttggatgtatgtggttaaataggaagagaaagtctaagggacattgtgtgtgaagtgaaatgtgaatgttttatttgaactccctgcggttctccccctccctgcagcatctggagccctctgctgttgaagacagtgggtgttgatgggaaacagcaaaggggaagcaagcggtccttggaattactttctctccacatttcagggaatgcactgactaaggacttggacaatctctgacctatcaatgcagggggtgactcttggttaaatcacttcctaaagagacatctctgtgccctgctgggaggcctatggtgaaccctgtgatagatctggggaccaggagttggtgaagggggcatacggctgagggaggaggtgcacagtagctccataccatgcaggctgaaactggagttggctggtctagggcgtcccatgggactagatgtgggtggtagagggtagcgttgggggaaggctgccagacagcatggaatgcacaatggggttactagaagaaaagggctgatcccagctttgtggtttgctggggatatcatcaagggctggtgatataggggtgctgcctccccttcttctgcaggtgaaagaggcacattctctcctttcatgtctgagatgtctccatcttgagcatggcactccaagctgaagtcatcaatggaaggcatgatgtactggatctgcacaggggactgcaggccatcttgtgacctcaggatatgccaggaacaatcacaaggactgtgttctccacggtcagctgcagcgctgtctctggggccaagatgaggatgacctcttccaggctcaacctcacttctgtcccttgttctaggactatgatgagctcctcattgctggaatcctgctgctcccgtgaaaagatggccgtcagtattctccaaaaaggctgcaaatgatgctgatgcggagggagttgccaggagcttcacccgctacaagtttaaaatacactccctcccagaattgactctcatgctgacccacctaaatgtacatccactggatgtctcttgagcttgaagagtgtgcagcactgtccaatctttgccatacaaggacatacgaacttacctggggaggtttctgggacgggcatgaattctggtgtggagctcctggaattgagggtgttttgcaatctttgccatgcaatgacataataacttacctggggaggttccagggactggcctgaattcagtgtggagctcctggaattgagggtgtttttgcacctgcagagagatcacagtgagggaggttaaggctcttccagcaagagtctcttggatttcagaatatgaccttcagaaatccacaacccagcacaggccagcctcaggacaccagcccccatcaatcaagcatgactttccactcatcctgcagaaagcaccctctccttttataagattgtgagacatgacactgacctccaggcagggagatcttaagaaatatcagggaaattgccttacctatactggtaccctgctccacttggtgacgtttgggtggattcatttgcgtggtagccaagctgcaggacagaaagggatccgttagtcttccacacagagtctaattctcacaagcccaaaactccatttatcatccagcacacattctttctgtgtccctcagtcaagtgcacttgtgttgggctccaaatcctacctgcatccagtaagtcctaatgctcatctcccaccctcaacttttctaatggcttttcctatcggtgaatgtgtgtgataagggatggtgaccacaggaaacagtttgctttctcaggagctcatccatctgagaagggacatctaatttggtctgaggattttcagggaagacgttgttatttcaggtatctgagcaccgtgtctgtgcagttacagtgtgaatggagtgagagatgatgggaaatgtttcattttctaatgagcacagggaagaaatttagatcatgcccacagtttacctgtctccgcacaagaggtgactttcatttagagagggaacatagatcgacagtgggaggaaacctgagatgagccccctgacaggtccagaaaccccccatgctggcaggatcctatggcctccactgtgggtctcatgtctccggcaggtgttctaaatttataacgttcaatgtcatggcaggccagggtgctttctctgccctagtttgaccctttatcacacattcacaccacacacacacacaaatgcacacagtcacacatagtcacatggcaacctcctggcaacccaaggtgaacacacactaacatacctgctctctccttcattgtcattctgcgattctgtccaggaatcactaaggcttctttggcgccagtaaccatacatggtaaaggttctctagactcacttgtatcagaaaatttcaatcttcatcttattttcttataaatctatacagtctatgacttgatcttttacttttcctgaagaagatgatcagctcggcacatccagaacatggaatagtgtgccctggcctgggacaggttgaatgacgctatggtagaatgaaatcttgggcaaatcccaaaagttttataatagagagagctgtgggatttatcaaaatggatgaacacgattggctagtgctgctgattaagtagtaggacctgcatgggagtgcttttatcaaaactcaagtgatatgggtgtgcccctgttagaattagcctaatctaatcaaaatcaatctaatgtaacctctactctgattcaccatagaaatgtgatataaaatatcagcattttaaaatagtgctatttacattctattgtatactattcattaattaggaaagacaattattttctgtaagtttcatgtgcataatcatttctgggtaaacataaaggattggttctaggaaactttgaaggtaacaatatttgtggatgctccacttccttgtataaagtggtagagaatttagatgtaacttactcatattaattcatatagcttaaattatctctagattacttataatacctaatacaatgcccagaccttacattacttacgtgttctcaacaaagaatttggtgaagggaaaattcaaatttttttttgtcggggggtggaaattgtgtaaatattttctgaatattttctattcaagtttagttgaatccatggagctggaacccatggatgtggagggctgacagtatttttttttttttgagatggagtctcactctgtctcccaggcaggaatgcagtagtacgatctcggctcactgcaagctccacccgctgggttcaagtgattttcctgcctcagagtaccgagtagctgtgattacaggcatgtgccaccacgcttgtctaatttttgtatttttagtagagacggggtttcaccgtgctggccaggctggtctcaaactcctgacctcaagtgatccatctacctcggcctcccaaagtgctgggattacagacgtgagccaccgcttctggtgacagtatttttaaataataaaataatatgtattttaagtgaaagaacttttaaaatgaatctcctggggaaagttatccaaacataataggctcatatcataagatgagctgggaaaaataccaaaaggacctttacttaatttctaatatatcactatgtgctaatctgtctgttggcttatttcttgcctgtatcccccactggaatggtttcagaattataatgcaagtttccctttcaacattacttattaattaaaaatccatgatttccatggacaaagtcacctaaacttccatcaggaggccagacaccaaatgcccaaactcagagttaatcattttatgattaaaaattatttgacaacataaaaaaggttggatggtattggggagaaaagatgaccagtaaataccaaaattgaactaaatggaaattctgtgaggctgcaccattactgaatgtgccgtcactaacaggcccttgagctcaggatgtcattctctccctagaaattgtataaatttgtttgtagattctttccatttagctgatatcctcctcagtcttattaggtgaagtacaggccctgctaacttcttaaaagcgcccacggcggaccttagtgtctttattcagaggtctgtctgctttgtggatttcggtcttttctgagcagaacagcagatactttgctgaagatcagatgtagtttgtttgtttgtttttcagacggagttgtgttctgttgcccaggctggagtgaggtggtgcagtctggctcactacaacctctgcctcccaggttcaagcgattctcctgtctcagcctctcgagtagctgggattagaggtgtgcaccaccatgcccggctactttttgtattttggttagagacggggttccaccatgttggccaggctggtctcaaactcctgacctcaagtgatctgcccatgtccgcctcacaaaatgttgggattaccggcatgagtcatggtgcccaaccagatgtagttttaaagttgggttacttggccgggcacggtggctcatgcctataatcccagcactttgggaggccgaggcaggcggatcaggaggtcagaagtttgagaccagcctggccaacatagtgaaaccccatctcaactaaaaatacaaaaaattagctgggtgtggtggcgggcacctgtaatcccagctactcgggaggctgagacaggagaatagcttgaacccgggaggcggaggttgcagtgagcgaagatcacgacattgcactccagcctggtgacagtgcgagactgtgtttaaaaaaaaaaaaacgggttacttctctacattctctctggttgtggggatcaggttaagatattcaagaaacagcttacactgagggttctggagtatgcatattttatggtcaagaaagaggcccctcattgtgagtttgtgtgtgtcaattctagctgaaaacctagtagaagaagaaaaatatgagggacttgccaaatattctacctttataatcgctttggctataaacaaaatgtgttttaaccaataaattaataaagttatagcttaaaaatctcaggatatatcctgcaacacagaataatgacttatttttgaagaaatatttaagcaatatattttcatttggggtccaaacttgttcacaagtgtacctcttccccttgcctttgaaattaaaaccattttttacatctgcagtgctgtgatgaagagaaagatgtggttctgaatgctttatcgtcaacaactgaatgttgaattaatgtccctctctttcattgtctatttttcagtgactttagcactgtaggaaagatgagcccctcacaatgtggaaatgcacggaggcagagcgcgggtttccctgcaagggcccctttcccacgggctgcactgaaattgtgtggccctgccctgacccgaccccttcctctgcagggtccccgtattctgtagattttcctcacaattcttcttgtttctcctcacaatcaatcctcaatgaggtcacagggaggacatgttacagcctgcttctattatctatcagaaagccctccctaaccccaaatttatacatttgtaaaataatgctaaagtatcccaacagaaaatacagaataaaacacgtggcaacagccctgaaaatgaagtctttatggctgtttcagaaaaatatccgggatactctgcagcgaatctcccttctcagcagttagggctgcggacaggaagttttcctcctgatggacatcgccttagttgccccaaagccagggcggcgcctcctccctgaccagaggaaaggaaactcacgtacttcctggagacccagccccgcctccgcaggcagaaagcgcatgcgccccggagggcgggacggcgtgttccctcgccctctgccggccatggggttgcagcgcaagaggcttggcttctaccgcttagcgatggacctaagtctctcaatggctgaaattctggtttagattattcagtacctttcttttggaggatcaaatgaaaatagagcacggtatcatttgctttgatggaagataactgaaataaagaagcaacgtccaaggaccatatacaaaaggcgattgattccctgtatgtggacggaagaggagcttgaataagagaagggttctgtgatactttaatgctggaaaactgctgctatgcatttgtcaaatcccatacaattttactgcataaatagtacatcttaatgtggctcaggactacagcttatgtcatgtaagatttgggggaaaattactatttaattaaataggttaaactgtgaacaataatgtgagccctgcctggaccagatggcttgccaagcagatggccatcctcatcctcacacagtacttgacaaaaaccctggcttcagtgtagaatcacttgtggagaatttttaggatgtaccacttccacccatgaattagcccatttaattggcctcagtaagtccatggtttcaggattttgcagtttgctaaaagttcaatgtcatcccaatttatttcctggaaccatttctccttgaagtttacattcagtactgagatttgctaaaagccaatgcatttccaagttctagagtcaaatcagacgacgcctccttggtcagaacttttattttgcttgcggaaaagtatattgaatcaaatataagaagggtttgcatggtggctgagtggttaaggtgctttatctgctagtccatagtaaggggagcacaactgtgtcctctgtgtcataactcaggactcatgaataaaacgtggagtgtcaggagatgaacttctactcccacctaggggagcttcaaggagaacgtctcaagggctttctgagggaaagaagagcagggatgcctaattctctggccccaggcagttgttcatgggcagagacaagggctggggtaattcaatggtttatactgggtgtttttgatactgcccccatttccctgttaaatctgtgtaatggatcactgagaaacctggcacctggggctgaagatccctgttgtgtcaactccagggatggatccagagaagtggttttggtggaagttggaatgaagggagtttggctgtgggaagaaaaaaaagctgttgatgatggggaaacgggaagagaaggatgaaatctctactcacatgctaaggatagcttatgcaaatctatgtgtcagacctgcataaataaaactagaactttaacaacatattagatttttcagcaacaggttttattgtttcaatatttgcaagtatttttctattaaaaaataataaagttgcttacataattttgtattcaaaattcccaggtcacataactgttatacatttacacttcacatttttaatgagtagatacattctctaaattatgaattatttgctcaattgtgtgttagttttttctttttattctccatgactccgttttctgacctgaaatctgcagtatttggtaatccacaagatgatcagttgcccttgtaaagactttcctttcctatttccttcttaagaaagcattttttactgagtttttttggtaacataccaacggtggtacctggctgaatgttggttcacagtgagtagagaccaaggcttctctcaaatggagtcccaaattctttacagagctaggaattctctactctgaaagtcctgtgtgttttaagttagagcttttgcaaactatttattatattgacagttttcattctcatgtcattctcatgtcatttatattcatttatagcaccaagtgtcccctcctacttggagagataattttgttctgtagttagtttaaaaagtcttgactctcccctcatcaagctgccttgtcattctgtacttggctcttggggcaggcaaggtcagtaggagatgccagtagagagtaaccaccactagcttcacaagaatgatgtgctgtgacgaattgtgatagggtttttccttctctttgccctaaagattctataccatatttcatgctctggagcaagagcaacttctttctcatggttttaatcacaataatctgatttcaagcatttaattcctttttttccagaacaactcattgaattatcaaaaatatgaaattaaggatacctacttattggcttgaactagctctgagcaatttagtaatcatgaacagaatggctctgctagaacaaaattcctgatcacttcagtccatccttgaaaatttgcagagagaggtcaagggaacatacacttccctgaaaattgtattttacagacccagttaaaaggccatgtaaggaaataatggagacagtagaagaatagacttactgattaaactaggttttgactgttaatataaaaaaaccaataccctttccaagagcacattgaaatagcgtaaaatcctttactaagtactaaaagatatttccaaaatataataaagactaaaaatctaaagaggcctcatcatctgaatctgaaacaaaagagaatataattaagactttttaaaaaaaccctaatgaattggggatctctttcctttactcctctgctgtggttggtcagaatcccctttctattctgtcctccacctctctcctgattctctttgtctgtgtcatctatcccactatttcttgcccacgtaactttcactatttttttcaacaccttctacaaagcttctagaactctttcactatcactgcttttcaaaatccatcagagacagcttcccaatactcaacgttaccttctttttcaacctcactctccctagctccctggctctctggttctcttttggcctctctttttctccttatgccctggcttcacatctacattcacaagaagagaatgaagaagcccccttcccaataagagcacgccttacactgggactccaaaatctaagcacaccctgacaggcacagccagtggaatgagatctgggacagaagatcacagggcgtcacaggactgtggccggtgatgtccaagccgagggggttcaggggcctccccgagtctgtgactaaggaaaggcctgagggcagcagggcagtgtcccaagagacgcgaggatgaaggaggggtgcgggcagggtggagggccttagaagactactgatgtctaagaaatcccaaagccagcgggaggttgtggccttcctcctcctggctttgcccacaaagggccgcgaggggtgagaatccacttccgagtggggacttagacggggcactgggtggggaggggagagggtgaaaagacaaaagacacaaaagcatggcggggcaccaacctcccagtgtctgacagcgacgtagggctactgcggctgagacacgtaggtgcggggattgtgacgtcggcagtgacaccagacgccagatcctaggtgtggaggatggtgacacggagttgtgaacagaaaatatcaaagtccactccaggaaaggggcctttcatccggaaaacctgcatccgggtccgccggaacctgcggtctcaggatggggtagtgggccagaaagagggcagagccagtgtggaccaggcctcagcatccctgctctgtccccagggcgtatcgggatctgtccccacttccggccagtgcagccttggtctccgcgtttgccacaacgcgagtgttttacgtgcagtggggctaggctgcttccaccagttgcaagttgagtgtttccgacactttatggtcagggtagtcagaccacttacagtggttgatgacccggttcattctgcacaaattaaaaacagtttaggaggctgggtgcggtggctcgcacctggaatcccagcactttgggaggctgaggtgggcggagtttgagacgagcctgggcaacagagcgagaccttgtttctacaaaaatacaaaaacttagccaggtgtggtggtgggtgcctgtggccccagctcctccagaggctgaagcatgagaatcactcgagcccaggaggtcgaggctgcagtgagccgtgatggggccactgcactccaggcggagcaacagaacgagaccccgtctcaaaccaaaccaaacaaaacaataacaacaaaagtttatggcagaagttcttcttcctctctagcgtgagtgggtggagctgcacatcttgagtggagcaggtcgtggcgccttcacgacccagggacccctggctggaggtggctggaccaggacccccaccagcccagtcagaacgggccatttattgtcagaactacaatgtgaattgccacagttggccggtggggagcgtggaaattcacaccaaggatgaggaatgtaggttccttttctactcctcaatcacccgggaggcagggacaaaagcaagggctctgttccagggactttttgagccaggacctgagctgggcccaggaggcccgaatctttgctttaaaagaacaaaagttactgtgtatattaataaattcctttatccatctttatatttaatgtgttcttttcacatttcttaagatgaatcataaatctgaattcctttgagacaaacgtggatgacatcccctaattttcttaggtaatcgttttagaatatattgtaatttcacatatttcagtgttctcagcactgtttgaaaaaatatttttaatttaaaatatgggatagtttaatgttttgttttctgtttcagagtattttgtgtcaactatgggtattgaggcatgtaaaatgcgtaccttttaggaaatacatgattttgtttagaactaatgaaaaattaaatgttcaatatttccatggacatttaccaagggatgtctactctcacacaagaacattttttaaaatagcaaaactgcattttcaattttcaataggcccattaatatccttaataaatgttaaagtgaaatatgtaagttagcatttcattttctacatttcctgattttcctttttcttaagtgcatgctagctggattttggaaagaccaaatcccaactgttcacactgcaaagatttctcaaagattatttccaaatgagggtacccttctggttttcccataactaataccagtttctttaaattttaagtttttttttttaaaaaaatcaatattttgattcaaaacggacttaaaacttgaatagcttcccttaggtaattgaacagaaagaacactgggattcatcagggtacttgggggatcagccctgctcactgcttctccagatttccagagctaagtttgttaagtttgtttcccctgagctgagctcatacctcccataactgctgggaagtggacacagattaaggagccaggattgtatgcaatttcagttgaagaaattcatacatctgagccttcccatttagtttttctgcagctccctctctcttcacataggagccaagtaatgtagctctgcctgtatgtaccgttcagacacttcgaccttctctaccaaatattttgttttttggtttctacaaaatatgagtttggggagtcttcaaatagactgaattgattcctcttgagtctgcacgggacacacattgtctacatttggaagccccttacgagaaactaacccactaaatgaatgtctgggtaaattaaggtctgctcactgtgtctctgagtctctgattccatgcctagaaaatggatctgataaaagacgaggagtgggctgggcgcgttggctcagtcctgtaatcccagcactttgggaggccgaggcgggtggatcacgaggtcaggagatcgagatcatcctggctaacgcggtgaaaccccgtctgtactaaaagtacaaaaaaattagccgggcgtagtggcgggtgcctgtagtcccagctactcaggaggctgaggcaggagaatggcgtgagccagaaggcggagcttgtatgagccaagattgtgccactgcactccagcctgggtgacagagcaagactccgtctcaagaaaaaaaaaaaaaaaaaaaaaaaaaaaaaaaaaaagctgagaagtgaaaaaaatgacaatacattgaagcataatttttaaaattatgatttatgattactatctaaaacaagatttttctgtcctaccttagaaaatttccttagcttttccagaagaaactacaactctaccaaagcacaatggttgtaggaaggctgtttgattgggtcactaagaagtcctgatgagaagatggtccatctaaaatgcaatgcagtgtatataaggcaacatgtgtccacatcacttcctgggcataaccagccctacctcctcagaggggatctgatcctaatgcacatgcatttccttggacaaaggtagggagtctgattcagagctgctccaaagcctgtccatgcagaagactttatacctgtagttcttgttcctaccttgaatgtgaaggagtacactcagtttcagagtgagagttttgatctctgtaagttctatttgaaaagaccagcggttgaccaaaaaaaaaaaaaaaaaaaaaaaaaagaggtacagccaaggattggaataaagtcataggaacagagtcaagcccagaagagcagcagtattgaaggacaatggattaggttgctaagattgatggtgatccttataagtcagcctgttacactgtttgccttgggtccacagagctttgtcatagctctctcttgtaagtttcttaaaatcactaaagaggcttgcttgaactcaggtgtctgagatcagcctgagcagtatagtaacacctcatctctactaaaataaaaaaatttagccagacatggtggcatgtgcctgtaatcccagctatgatggtgccactgcactccagactgggaaacagaatgagaccctgtctcaaaaaaaaaaaaaaaaaaaaaaaaatcaggaaagtgccccattttctactactcagatcctgttgagtttcagtgatgaaggagaggtggatccagacacctggagcacctcttactgcagttcatctaagtcagcctttacctggcccgctctgctgttcacacagccggaagggcttgtgcacgggttagaagactacagttctctctgtcatcagttttcctggtttctcatacagccccttctccacatatagatagtggagattttgcccaggggattccctcaaggtctcagtttcgttaaacttgtcaaggcttccacagattgttttgccacctagtgagacttgtttcgaaaaaaaaaaaaaaaaagtgaaatgggaaaaaaattaagtggcaaatgagaatgataatagtcctcacaggtgaaggtgaccatagagacagaagataggtggcttcattttggtcagcagctcacctgggccagtggaatgtctttgtttggatgaaaaggacctttctatacctcgatatagacaatcagggacagaggtgcaccatatgagcagaatggctttcataagagaacagagagtccttaacattttcggttcagttccccagaagaatgaaagtgagcagttttgaatggaaataattgtcaaatgggaacataaactacaaatatattggcaacaaaggaagtttagcagcaatactccttcagtttcagttaaagtgatttacgctaagttgataaaccagttggtttaaatggtcacaggacattttgtctgtgaaacctctctggaccccaatgactccagtcgtaattagtctaaatgcacatgttctaaactcccacaggtctcggatcaggatgtagaacttaacacatggaatgttcatttgctgtacatgtgtctgtctacccaataaagtttgagcttctgttcctggggttgagcaaggtgaaccacttggtcatgccctctccatacctcctttacaaatggaaaagtgcaacacagtgatatgccactggacatgaaggcagcaatcctggatttgagcctgaatctatttctgcaactaactggaggtgtgtgacagagatcaatggatctcagatgcttctgtgttcagtgatcaacaggtctcaaatgtcactgtgcaggagacttaattggaaaagtcattttacaaatttagattctgaagagatccccatttgaaagtgttagagtggggcatagagctctaattataagtattctaggctagttacactgactataattaaccaatatagttctggaagcagggacttaagtgatctctaaggctacttctagttctaatatttgagtgttctaaggattcgtagacatctgaatataaatcttagactaatttttatggtttttcaattcacatgggtgtgtgtatgctcgtgtgtgtgctcatacatcatgaaaaagtagaactattcctttacttcatgcaaagttcaatccacaaattataagtaaattttagataattggcagtgagggtgaatttgttaacaccaagtttgacagagtaagagcagaggctgaagataataagacactgatctagaacaacatcagtgaggagaaagagggaaggagataattgcattaagatttacagggattaataagcaatttatgcagattaatgtcatgagtaaattgtgtgacttattcagaaaagtaagcattcctgagtaaacctctacttttaccctgaatgtcaagtaaacgatagtaatattttctaagatttagaatattaaacgaaggccagatttggaagcaaaccaataaattgcaataaagacattacctttgaagtgcctatcagaaatccacttagagtagctcagtaaacttaaattggatacataagtagtggaaggttgaaaaggcacagagataaccatacaaaagggatatcgccttttaacatataggaacaaaggagtaaagttactctcaggggctagcgcccaaaattatcttacttgtacgcagctagagcttgaacctatgaggaggagacacagtaccaggtgcccatgtctcctagtgggttacaccacatcagtcacgcttaaaatttgaagggagcaatgctcaatgactgatgtgcaggcaaatgaggcagaggcacttgatagccagtgttcagacttctgaggaggagacatggtccaacaggtgcttggatagacaaggtgcatagaaaatcagattgtagctcagccggtcctcttacaaccaaggaggtagagctaggaggctgctggtccttttctggcgtatttgtggggctgctgagaaagtggaaagaatataaagcctgaagcctggagccaaccatctgctgctattggaatggggctgacaaaaacggcatagaacagatgccttcactcttggtcttgttttccactctcctgctaatacctttcattaaaggtgctaacaagaagctaactggccaagcagtataacaaatgctgttttcagagtcccagcacagcaccacagagcagagtaaagaaatcataaaagtaaagaagtaacaccatgtcattagtccataaagagtgggaaccatgagaatggaggagattgtttggagataacacgtataataagaagagaatgaaacataggtgaaagcaatcctagccaagagaatatgaggaacagtcagcaaagaagactgagaatgtgtggagaagacaaagagaaatgtccagcagacaaacattctcacggccagaagagagagaaattaaggtgcaggagatagatcaccttgtaaaatgtttcagaaagggcctgaaggatgaatactggccataggtcactggagttggccctggtaatttattaagagaaaaactactattaactgactaaggaggtacctggtacctttataaagagaaattccaatagtatgatgagagctaaaataatcttcttcttcttcttcttttttcttcttctccttcttcttcttttgaaacagggtctctttttttttttttttttttttttttttttttgagacagagtctccctctgtcactcaggctggagtgcaatggcatgatcaggctcactgcagcctcaacttccagggctcagcccccaagcaattggggctatgggtgtgagccactataccgggcttttcttttctttttttttttttttgagacgtagacttgctcttgtcacccaggctggagtgcaatggcatgatcttggctcactgcaacctctgcctcccgggttcaagcgattcccctgtctcagactcccaaggagctgggattacagatgcatgccaccacgcctggctgctttttgtatttttagtagagacggggtttcaccaggttggtcaagctggtctcaaactcccgaccttgtgatttgcccacctcggccccccaaagtgctgggattacaggcgtgagccactgtgcccagcctaaatttttaaatttttgtagagatggggtctccctatgttgcccaggctggtctcgaactcctgggctcaaaggatcctcctgtcttggcctcccaaagtgctgaaattgcaggcatgagcctccatgcctggctttaagagatttctataggttgagaaggaaatagggtataaaaacactggagacaggaaatgtatgctatatttcaagtcatttgactgacagagaaagaagaggaaaaataaaaaatgaagaaacgagaaagtctaaacacacttagattctcaaaggcagttagttttatctgagacaatgtttaaggaatttctagggaaaatgcagaacagaaaaatcctctgattgaaacagataactttacatattttcctccagcatagttttcagaataagaaaattagcaccatgaagacaagtggcaataccagaagatctttcaaaacacattttattttttattttaaaacattttacacgttgtcttgttccagattttttttcctcttttatttacatctctacaggaagccagcttaactgaatagagaaggacattttctagagcagcgcagagggattttacttcttctgttctgggatggtgtactataaatcttctacgatgaaatggtctgtgatatatgctttcttctgctggaaagctgggactccaaattttggcaaattagggaaaaggtaagcctcagtttgccattgttatgctctgaaagggcagggtttgcaggattacaaaagagattcttagaaagtgtctttttttctttctatggtttttttttttttcagtttgtttcaatttcttcctccatttaactgttcacctgaacccgctgagaaacgttccatctttaggactgccttttgttgttctattatcttccagcctgctattttgtggacatgctaagcagacaagtccagaaagcccgaagttggaatataaatgtgactaagtcagtaactgtataatcttcttcagtctcactctcctcctttgtaataagggcactgaattcgatgacctttggggaacttactgcttcagaaacccatgatttgatcaattctcactgcaaatggccagaatgaagatgttgctcaagctacagccaacttgaattttgatatgggtgcatttcattctaaaacttgatgttttagatcgaacaggtaaatgaacaagaatctaaacagttcctacctataaaagagagaaaggagtacatgacagtgatactgctgaagcagccacaatgagcatctagcaggtataccgtttactgagaggttcaatctgctcacattatagataccagaatcctggcacagagggcccaatgtcctacatctgtttaaagccagagctatgactttagaactcaattcacctgagtgccagtccaaccattccattccatctgttttatctgtgtattcaatggctcacttttatataaagtaaaagaaatcattaataggccctgtgtcaggaactgagagtgcaaaggtcaacaagatatagtgtctgcctggaagaagttcacagcctaggaagggtatctccttgtagcactgggaactggacagacatggcttcagataatccaacctttgcagatcaaagagagatggtccagagagatttatcccactgatatcgcagccagagaatcttcacctctttgtttcttgcagctggtgcttagtttttaatgtttctttctgtttttgcagcaaaatggtgctaattcagctctacagcccccaatctttacttcaaaggtaagacattcggcttcacagtgaccttccattctcttactaattagtgctctatgaattgctgtcctggctaagtaaagaaagcaatttgtcttcagttatctagtaattagtaactgtaagataaaattacatcgcccaggccaaattcagacttcctcattaccataactcctagagacacagactataaacctagaaattagaaaaatcagatgttatctgaacagtcatgtctgagctcagacccctggtacaatataatcaatgtccttattaaatagccaattggaaaaaaacagaaaagattttcatatgtcaaaatcatatctagcttgtacagaaacagaatgtttcttccaaggaagatgacaaaatactttctaattccaatgaacgatccttaccaacagattttttttcccctgtatccaaatagtctctgatttatagcaaaagttaaagattgttctgttacattataggcaggccaatagtagatcatatgccctggcatatgatttcggagtctcacagttttaggtagaaagataaacaacatgatgctagtccttctcaatttactgtgcaaagaacaccaatggaatcgtgtatttagctctggcaagcaaatttagagagacacaggcaatgtgtgttcattcataacagagattaggttgaagaggaaaaaatatgtcaaaacaggaatcttttttaattggtaagatacattcttaggaaacaatagtggaagaagtagcagttcttctcaaaaggagtaatgtttattcctggaaataacaactttgggggagaaacagtacatattagctgccatatatctgaaatattatcatgtggaatatattttgttagtgccaagttaaggcaaagactaatggaaagaaattgcagggacttagatttctgctcaaattaaggagaaatttttgaatagtccaaagttgaacttgggatactgtgaactacagatcacttaaatttatcaggcaactggacaatcagttgagacacacacacgcacacacatacacacacacacacacacatatatatatatatacatgtatagggtgttcaatactgaatcagggcagagaacaaaaaaataagtagaagaacaaatgaccaacaatggtaaactctaacatagcatagagtatgtgcctgccactgctcaagcagttatacagagagattgttaaactgtcccaaagcagtcatttttaccttcagacttttagtcatagaacctctgggtttagctggacacatgaatacttagctattcacatcagctcctagcttcctatttctatatgtccacatgaacaaatttggaaaaatgaaaaaggagtggaatgatgtgagctgcttctatgtaatcttaatcaggttctatactttctaaccctgcctgttagaatatccttggaaccaaataaaatggtcaactgtttaggatggcagggttgaccttcagcccaaatcacaacataacttggtgaaaaagaaccctctacccgcacctagtcaacttagctatttttggacttttacatgaaagagaaataaggttttgtctttcttcagtcattctatcattaagattctttattataacaagttagtttctaattaatataacaagtttattcatcttcaaaacaatgctattattattatcatttatagaatggaaagtaaaacacagggtgcatacagcttataaagattagcactgagatccaaactcatataagtttggcctaataacctatgtttattaccttttatattgatcattaaattcacttctaactctgagattctatgtgattatggtgatggtggtggttctaatttgtgcccaaactatgcttattattgtaattcaaatacatctgagatgagttttgtggacagggagctattaggcatccacatctatagactgatctgaataaattggagtactgattaaagtggatggagaagacaattttaaatgagtttatctattctggagcattgtctgacatctgcaaaaagatgctgagggcagaaaatcgggaactgattttacaactgacactttcatggagtcactgaaactttcatggggacattgttccctggctctgttctttagttctagtcttgcctatttccaaatgtgcaaaacaaatactacttcccaggaagcctttctgcatttcctagttagaaccaagtttccacatctatgacttctctttataatttgcatcttttatggcacttgtgaaaactgtttcatattaaagttatttgtgaattttcctgtctcattgatacttacttatacatgttaaatgtattgaaagcttatttaccactacaagcaacctattttcgaacaacacagaaggaatagactaataacttcaagcaaattaaggtcaatgtccatgctttatatttttacctcttcgttttacctacctttatcatagtggacagaacaatttcttacaagtggttagcacacattcaatatctattggttttctaggactactgaggacagaatgtgtaataaaggaatgtagaaattcaggagccatgaaggaacagacagggggcttcatgatgcatggagaacctctaataggaaaagcttcacaacagaaggaacgaaggatagttgaggaggtatggacataaacatttcttaggaacagagtcgtggttgtatgaagcaaagagaatctcaaagacgcaaagacttaagagaatagtaagcaagatgttagtttagtggttttaatggcataatttccaaccagtgtgtgaaagccaaaaagtctaaaataatgtatggataagagatttggaccgacgactcagacatgaaaaaaaattagctgtctaagaatctagtaacataactttagtttaatttagactacaaaggctgtacttccctaacttaacaaatatgtttggcatttccttggataatcttttctttctttttttttttttttttcattttaaagaaatcactttagaatatgctggccaggcgcggtggctcatgcctgtaatcccagggctctgggaggccgaggagggcggatcacgaagtcaggacatcaagaccatcctggctaacacagtgaaaccccgtctctactaaaaatacaaaaaaattacccaggcgtggtggcgggtgcgtgtagtcccagctactcgggaggctgaggcaggagaatggcatgaacctgggaggcagagcttgcagtgagccgagatcgcaccactgcactccagcctgggcgacagcgcgagactccgtctcaaaaaaaaaaaaaaaaaaaaaaaagaatatgctgaacctgcgttgcagattacaaaggaggaaagagatctaaaagtacaaagatgtctgaattccttggcagagctgttagggaagttgactagaaactattatggatggagatggtcccggtcaatgtggtcccattgttttgtgtcggagctcaggaaaagattttcagtgactggtttgccttggaaccttcaactttgtaaaagttgagctttcatctcaaaagacagatcctgagcagactgtcatctctacttctagaagaatttccctcttaccttggaaaatttgagcaagaagaatgagagcagccaaaataaagacaaatattttcatggctccaggcatcagtggagagctgatgaaggaagtgcagtagctggaatcaagctcttttatcaaggggcattgattaaaatatgttctactgccctgaagggactggaagtcatcctcggtttgtaatgttcattgggaacatactattttccatgctccactgattaatgtgtgggctgatggatcagattttaactaaaccacatttgtgggagacaaacgcagagaaccctgcctttctgcctggaatattctattctgtgtctctgcttagacttctctcatttttccttcaagtcttatctcaagtattaccatgtctataagatatatagccaccacgcttttcctagtacatgattttacataaaacctattcttaaaataataattaaaacaaacacacaaaaacctttaattttaaattcaggagtacgtgtgcaggttttttttttttttttttttgacagggtctcgctgtattgcatggagtgctgttgcttaaggagaaaagggttaatccattgaaaatacataaaaaccattaacatgtttttatattatttgatttaattaaagggagaaatagacacttctatattcatagtagaaaatttttacaccactctctcagcaactgatagaacacagggaaaaattagcaaagtcatgcatgatctgaacaataccaccattccactgactgcattgatatttatagaacacatcataagacaactgcaaaatacacatttttttcaagtacatatgatacattcataaaaatgaaccatatgctaggccataaaacaaatattgatgtgtttaagcacatttaaatacttcagagtgtatttctcaccacaaggggattaaattggcaatctataaaataagctatttaggatattttcaaatatgtggagataaagcaacatcattctagattgtgtttgtatcaaagaataaataatgagaataattggaaagcatttctgtatatcgaattttgtggagcacaacaaaacaatgacttcgaaagaaatttgtatccaaatacttattgtagaaaagaagaaatgtttaaatctatgacttaaaattatgctctaagaaccttagaaaagggaacaatgtaagcccaagtatgcagaataagtgaaaaagaagttatcactacagatccaagaaacattaaactaatataaaaatgttgtcaacaggtatatgccaaaacatttcacaacttacataaaataaaagaattctctcaaaaatttaacttaccaaaattggcacaagaattagcagaaaatataagtatttctgtatgtcttaaagaaagtaagtgtgttattaaatgaagaatggcttctgcttaagatgtagaaatacgtaaagaaaatcatcccacatgaaacaagtacacagcaaaacacacggcagactgcaaatattcagtttctttaactcattggaaagctaaggtcacaaatcagccacctacctagaaatataagaaaagacaggaacctccaaaaaataaagaccatgagtgcttgcttacctgaagcagattacccccagaatatgatttaaaagatttcaggtaaagtctgtagagaattgctaagagcaagcataaactagagaaacaatataaatgtctggggtcacagacaaaagagaagttcacagcaacttctaatgtcttctccatagactcagcaggtgcttacaaaaaagattagagtatttcatgatgtaagtcggctgaggggaacagtagccactgtgagaaagaacaaaagcttgcaagaatctttctcttttatggaaaagaaagtcttaatttcttaattaagaaactgagggaagaacaacagttgtttgtacggcactggtgaatgaacaatctaaaaaaatgcaaaacaaaatattaaagctaggagaacgaggagaagggagcacattaaaaaagaaaaacaaagaacatcctctacctttgtcaacagagaaggcatacatgcctcctgcctgtagaaagatgacagaataactgcagcaaacttctcatcaaaaaatatgcaagccaggacaggtgtggcggttcacgcctgtaatcccagcactttgggaggccaaggtgggcagatcacttgagccaggagtttagttcgaaactagcctgggcaacataatgagacccctatctctacaaaacatacgaaaattaactggacatggtggcaggcacctgtggtcccagccactcaggaggctgaggtgggaggatcacttgagccccggaggcagaggatggggtgagccgagatcataccactgcactgcagcctgagcttcagagtgagaccctgtctgaaaaaaaaatcgaggcaaaataaaatagagtaacatctttacaatgttccagtggagccatttggccctgggttttactatgtgggatttttgttagtgttattactgtcaattcatgcactttatttgttataggtccattttagactttctatttcttcttgaattaggtttgatatgtatgcatttctaggcatttattcatctagattatcaaaattgttgccataaaattgtttatagtattccttaataatattaaaaaatacttttgtaagatcttttgtaaaacttctctttcactcatgattttagtaatatgagtattctctttttttcttagtcagtctagttagaggcttgccaattttgttgatcatttcaaaaaataaatttttgttgtgttgatttattctattgttttcttagtctctatttcatttatttccgtgctaatatttattattttcttccttgtgcttgctttgggtttagttggctcttccttaattttcttgagatggaagataatttactgattttaaatctatcttctttataaatacaggcatttacaaccatacattttcctgtaagcattgttttagctgcatctcacagttttggtaagttgctgttgtgttgtatattttaaagtgtttgggggctccctttaaaatattttctacattcccttatgttttctgctttgacccatcatttattcacatttatgctgtttaatttccacatagttgtgactttcccaaatttctttctattatcccattttgttcagagaacatactttgtatgattcctatccttttaaatgtattgaggagcttgtatttaaatctaacatacagtctattctaaagaatatttcatgtgaacagaagaagaatgtgtattttgctgtaattggtgcagtgttccacgctttgaggtcattgtgttacagtgctattcaaattttgtatttccttgctaatcttttttctagttgttttgtctattattaaaagtggtatattaaagtctcctgctattactgttgacttctctatttctcccttcaattctgtcaattttctcttcatgtattttggcactctgttgttaggtgcatgtttttatacttgttatattatcgtgatagattaacttgctaacattacaaaatgcccttcttcatctttagtaccaattttgtcttaaagtttgttttgtacactattggtatagccactacagctctcttttggttattgtttgtatggcaaatctctttccatccttttactttcagtctctttgtttccatgaatctaaagtgtaaagaaagtgttcctggaccaaacggagagttgggctgctatttctcacagcccaataacaagatgcaaataaactcgggaggaagagagtttttatttctgcaaccagttatagggagaagtcctggaaattatcgccagaccaacttaaaattacaaagttttccagagcttatataccttccaagctatatgtttatgtgtaagtgtgcattcatctaaagacataagttattaacttcttttaatctataactaaggtctgagtcccgaagaccttcctctggagcctcagtaaatgtacttaatctaaatgggtccaggtgctggggttattaccctcaccttgtctcctgctaaatcactgatatttggggagtttcttcagacctcctataaacttgtttaatcctaaacgggtcctgttaagaactccttcattagtttgtcgtgctttaaggcccaggaaaggcctaagcaaaactcttagtgggcttttgttacattcaagcctttatatcagggcactggctttttaagcttttaatatttaacttaacccctcagtgggtactaaagcagttgttatggagtcttgcgttagtgagacttggcctgccatgaaagggaacaatttgtgactaggtgagcacctgtgggaggtgtcctctgcagctgccatctggatgctacatgaggtcattagtgaggtaatatcagggcacagctactggtctaccactttgtatgactctgagacactcacatgaatctttcattaaaagaaacttcaactaggttccagagcatttttttaagataaagcaatgcagtatttggaatgagtaagtagtattccagtttcatggtgttctgtaagctagcagctgcatttgcactgtggagacctggggaggaagaccatctgccagcagaaaattactgtgaactggactcttaagaccaaataccccacttcccacttccctggggtaattcctgtgtaaatgaaggaaacactctaggcttcttgagggctgtgtttcaaatctcttttggaaaacagtggatcatatgtaaatagagtgaatctaaaaattgaaccaatcaagcattaaaagggttcccccaatggatagttctatagaaagaatttaatatgtacagataaagtgttggaaaagatgacaatgcaaagcgggagcaatgaggcaaccctactgatagtcacagcagaaatctcccactgccctaaggtttgaggaaaaatggaaggatttgtgtgagcctgggagcagcactggctggcagaagctaaacttgcggtgggactgccaggtgagtgcagaagacagaaaagcagcggccttgctgagcatgaaaagccactgctggaaaagagagggagtcggggagaaattcacattgtccttccttcttcaatctcccattctcctaggagacacattgaccaaaactagccagaagtcaggaagcctggaaaatgtagtttgcaactaatagttcccattttactcagcaaagcagaaaaaaacaaggaacagatttgagcacaaagagacaaataataggcccaaatgttaaacaaaacattgtttaatctcatacgttaaaactaagtaaccaagttcaagtcactggtcatagggctggtaattttggcctttattttgtgaagctggattttatttcacaaggcaaaattagacagtcaaccatttatgcatattctgtgttgaacattttaagttaatctctaatcattttctttcacaggtaaatacaccataagtactagaatcaatgaatgacaatatttagacaaaccaagaaataatgtgaatataaaaataatgtattatatttgatagaattattattccattaacatagttagtacatatagatggatacataaaacatgacagcaatgtgcacagcagttactggatcctagctatggctctgaagaattaacagcctcttgagcctcaatattttcaaatgtaaatggcagtaataaaacctacctcataaggtaatcatgagtcatatgagagaagtatggaaaatacttcataaattgtaaggtactctacatatacatagtagtggtatctgattgagcagatactaggtacacactcatgtcttgatgttttttaaaggtcatctcgcccagcatggtggctcatgcctataatcccagcacttttggaggccaaggcgagcagatcacctgaggtcaggagatcgagaccagccttgccaacatggtgaaacctcatctctagtaaaaatacaaaaattagccaggcatggcggtatgcgcctgtagtcccagctacttgggaggctgaagcaggagaattgcttgaacccgggaggtggaggttgcagtgagccaagatcgagccactgcactccagcctgggcgacagagtgagactccttctcaaaaaaaaaaaaaaagaaaaaaagtcatctttaaaaaataagcaataaaacgtaacaaagggagaaagaaatgagaatgattctgagactcactcactgtgtgatttggataagccacataacttctcttgaacttctttgaatatccaggtctgcttctaaggccagaagtgtgctggtctggtttgtcagatcctctgtctgcagcagagaaagttcagcctgcaatttccatcgggcttctcattctccaagcactccttcctgcattttccccgaccaagcttgcacgactcacagacagcaaactcacctgtgccaagaaagagctgctgagggagctttccaggaaatgtctagaaatggggaacatgtcaaagaccaccaaaaaaaaagggacagttcgtacgtatgattacaaagaatattttcaagaatcagcccagatttttcaaaaatagtttctgctttttgcagtagggagttggggagagttaatttttatgcaacagatcatcgcaattcctactctccaagtgtttataatctggcagggatcaaaagtaaaccacagacagacaaagagacatacatattacagaactataaaaatacatacctgatatgactgtgaagtttactagacaaaaaatgggaggggtatattgtggttttttaaagatccttgaagatcaactctagtttgggcctagtagccggcaggttaaggtccatattctcatttgtccagtggccattctagaagcacctgactacattttttaaatcagtttagggatcaaatggaatattatatgtaaatattttcattataataatacctaccacataggactgttttgaggattacatgacaaagtccatgtaaagtttttagcaggatgcctggtacagagcaaacactcaaggactagtagcaaccttcatatttctcactttgaaattctgtctaaaaccatttcaactttgtctacaatatttcttttagttttgtttacaatgtcctttctttctgtataagatgacttcaaagaaaaagaaaagatctgggggctattcgttatgaatagcttttctgcaatggtgctgagttttcactgaggcaacctcactctttaatttgagcttccttcaactaacctcatgcatttgtgacatatattattaccagacttagcagcagagcttgcaagagatgggcaggcgtgttcacagagcagtgctaattggctggtacaagaataaatctaagaacttggtttagtgagcaccaacagctaatgggaaaagccactgagtccaaatctctatggccaaattacagtccagtcacaaagatatttttctgtgaaatcaaaaatatccaaatattatacttggaacaagagaaagagaaggagataagttagtgaactgatttttcagacaattctatttctgccactatctctgtcccctctttgcctccagacatcagagagagctaacagcgccagagctcctaagagaaaaaataattatatacaagagatttaacttacctgatggaaatggttgggaaaaatcaagtcctgcctggcaccctaaattcaaaacaaaatacattttgaaaattaaaatcaacacaggaattaacactgtataaaacactcccaacttcacatgtgacatagcataacaggagacagtagatcacagagttgcaatctttattctgtttctcaaggccagcattccaggtaaccagcaaaaacaaattacaaaaaaaaaaaaatacactatatgctgtttgctcttagtaaatgtcactgtaggtctaagaaattcccatgacaggtgccatgagagcttgaccattaaggtcaaacatggaagaatcaacaggctttataatctgcccaatcaaaatcccatccatttttacttacctgatggcagttgaaccaaaatgaagaacatagcaaatagaaaataaaatgtcttcctgatcagggccatcttttagggaagactcttcggaatagagattgggatttccttgagaagacccaaatgagaggctcatttttatttaaaagtaatggggagatgctcttgatccgtgaagtgaatcaataaaacacaattatatgctccatttcccaggataaagggatgatatcatggataataacccttggcatccagaaagccttttattttggggagtctaactggtgtagtggaaagaacaccaggctagaggttgaaagagcaggggccatgtgagtttccaccatactaatgcaggggccagaagatagtgacccctttcatctcttccagcttctgttttctgggagaaaataagaacccacttgcaaattctgcctgcctctaaaggtgttgtaagaatctagtatgattataatgcaaaagtgttttgaatatgtggaatgcttggaaggaggcctggtaccatgtaagaactcaataaatgtggactctcacttttctagctttcatttttattctctacaagtatcacagggagaaaaggaggggtagcaatcattttgtcaagttagctctgagtcccctttcctgtaagatatcacctcacgcaccaaagccataattactgcatattttaaattcattaaggacatgaatattggcccagatgggtggcttatgtctattatcgtagcttttgggagcctaaggcaggtagattgcttgagcccaggtgtctagggcaaggcatgatggttaccagctccttgctgcgccaacagtgccatggtacaggtgagcagcatggcaggaccaagcacgaaaagcgtgcagcatacagcaagattcacattttttaacaaatatatgcttaggtcaagccctttgccaagtttacaaagctcaaaaagactgaatctggaattcagattccacctcactacggttcctcagctcttaactgaagcattgagatattgtataattactcccattttacatatgagtaaaccaaagctgttcaggaacacagccaggattagaaaccaaactactggactccagatttttttattttttctgtgtctgccctactctgtcctcccttcatccccactttccttcttcaaaactttccagaatcagaaatatgatgagctgtagactgagtgacacccactgaggttgggtgggctctgtgcagcagagcatggaaatcctctcgtttctgctaagcctcactgatcaagatgttacttggtctggagaaatgtataaatgtgggtgtttgcggctctttcctcatggacacggtgctgatctctcaagacccacccagtcatgaggactttcctctttctctttgccgtgctcttctttctgaccccaggtaaaatgggcatctttacagggaaggtgatcggaggtggtgtcccacagacagggtccccttcagtgaatgcctgggcgtgatcaacccatctactacaagaggtgatattccccaacgcctcttctgtaattcctttgcattttacattgttatctaggaggggctgtcacaggtttgaaagaataaaagaaggccaggaaagatgccttttggcatcccatctcatgctcactaacaaaaacaaaaattgagaaaaaattaaaaacaaggatagcagtctatgaaccttttaaaatgtagttatggtagagattgagacaggtaaggagaagggacaggtaaggatctgagcttagagacacctatgcactcatgccagtcatggcaacaggtaaagcagcgtaacttggactgccatttcttgatcacatatcatcaagccaagtactgtgatgagagcttcacataaaatgcatctagtcttccagtgccagcgcctttacggaaaactctgtcttacccctaatttaatggaagttagagaaaatctttttgggtttgaaggtccattttacaaattttattacagatgcagaaattgtgcctcagatgggctcagtgcttctcagagtcttatagataaccaaaacaaagccagggtaggagcccaactgtcttgccacagtaagaggcattaaagacacccttcccatatcaaaactctcttcattttctcctgctcctgggaatctccagtggctccaattgtatcctcttcaaaattaaggcttaagaccaggctcatgtgagcctccagagagctgaagaaagggattctcagagcccacagtaactcccaatttctgccagataccagtgatatacgatcccaggtatgatgctcaacttttcacatcagctgctcatagctctggtctgttttgtgacaagcctgtgagagtagattctgtgtcaaaacatgaggatctaggacccacagtgacctatgccgtattcaggccactggttttgatatgcacgttcgaaactggccagaggtatctttttcagatcactcatacttattatataataagtcaaaaaaaagatgttatatactataaaattatctgttagataatactataattataaaagtataattagttactataattattatgtaattacagatacttatctataattacataatgcttgttatataattattagataatctaataattacctattagatatactagagtataatactataatacaatagtattagagaaaatctttttggtttagtatagtattatagtatagcatagtatatactataattatttactgatgttacagtatggtattgtactagtattatatactatatagtattgtactagtatatattatatatatatatatacatattttttttttttttttgagatagagtctcactctgttccccgggctggagtgcagtttcacaatctcagctcactgcaacctctgccaccggggttcatgcgattctcctgcctcagcctcctgagtagctgggattacaggcatgtgccaccttgcctggctaattttttgtatttttagtagagacggggtttcaccgtgttggtcagcctggtctcgaactcctgacctcgtgatccaccctcctcagcctcccaaagtgctgggattataggtgtgagacactgcacctggccagatactatattatactagtatattattactagtagtattatatactagtatgtaatatagtatatatactagtataatactctagtatatagtatagtatacatactagtataatactctagtatatagcatagtatacatactagtataatactctagtatatagtatagtgtatatactagtataatacacaagtatatagtatagtgtatatactagtataatacactagtatatagtatagtgtatatactaatatatacactagtatacagtatagtgtatatactagtataatactctagcatatagtatagtgtatatactagtataatacactagtatatagtatagtgtatatactagtataatacactagtatatagtatagtgtatatactagtataatacactaatatatagtatagtgtatatactattataatactctagtatatagtatatatactagtataatactctagtatatagtatagtatatatactggtatgataatatagtatatatactatattattactagtagtattatatactagtacatagtatagtgtacatactagtataatacactagtatatagtatagtatactagtataatacactggtatatagtatatatactactataacacactagtatatagtatagtatatatactagtataatactatagtatacactattataccagtatatactataatactagtatttttatagtatatactaagctatactatgatactatactaaaccaaaaagattttatctgaataccacgctatagtctatagtatagtattatattagtatctgccttacagtagggcagagagaacatagacccctgccagtgagagccagagttcatcgagctttgaaatagtggagtattttcacttatgaactgatgtgctgatcctggataatcattagtgcatatgctggcactaatccacctggctgtaagttttatgtagatttgaattaggcacctttatatgttgacattaaatgtatatacattatagtatagacattaaatgcaatctctgtacatctgatgccttcattatatatacacaaattgggcagctctaaaatgttgatcctgataagacgtgctgtctgtccttaacttgaagcaggctgctcttgggactgctactgataaagccctaaggtgggaactggaattctccgcaaaatgaactgagaaaatcttagaaaaacattcccaacatgctgcaccctccttctctaaagcacaagttttccgcagtcgttgctttggtgaatatggaggagaaatcaggctgagccttccaagcaagtttctatctaccacagtaaactcattctctttttatatctttatcccttcctttgctctggtctggagctatctcctcagtctcagctcttgctctactctcaccaagtagcagcctctgagagtgcactaggaaaattagcagcctctgggagtgtttatgggaacaagttgataattatccccaacagatttcgattaaagaaccatagcttagggacgtttcccaaagctcctacacagcttggtctcaaatgctggaagacaaatgtattctttccggtatttcaccctgtgtgactatgagactgaaatatcagataaaaatcaggtcccctaccatctcatttaccggtaggatatggcactatgacagcttgtgaaaaaatcttcaccaagtagtcatacaactgtatctggtaaacatacatgtctgaaaagggaattaatccaaatggctccttccctcgtgtagccaagaatgcattttttgatgagaaatgcaacaaacttaaagggacatgcaagaacaattgcgggaaaaatgaagaacttattgctctctgccagaagtctctgaaatgctgtcggaccatccagccatgtgggagcattatagattaatgcagaagatttaggtttccagagaagcatacataacctagcttctttttactcttgcctctgctgtaggcagacactttaataaaaataaatgactgtctttgctcagtttgtcaagtgtttcatttagaaaggagaacaacactgcctgaccttgatgctccctccatcccggtttatttttctatcattctggagtagataaattgtcccaaagccatctgatatttttcttaaaagaggactagaagagactagaaatcaacaaatctctagcttgtgctcagtctagtaagttggcgcttactaacctattgacatgaaagaagtaaacaaaagaaaataaagaaaagagagagggaggtggaaagaagatgaataggtagagaaatgagcacacttttttttaatacaaaacaaaattttattctttttttctttttctttttattatactttaagttctagggtacatgtgcacaatgtgcaggtttgttacatatgtacacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgtggtgtttggttttttgtccttgaaactggaaaccatcattctcatcaaactatctcaagagaacactttttaaaaatttttaccatcatgccatatgcccacataaatgagcatacatttacatgaatagctacatgaacgacaaattgatggataggcggtccatttatcaaagacttttatgtgtcacacacacacctgtctaaattaatcatcatgaccccatgtctttaattggggctagttaaatattttctatagacttgttctctacacgtaagtctgagataaaatttgctgacaggcaagggagtcataattacctctatgagtctcagtaactccagtgatttagaccctcttccccaaatcactgcctacgattttcctaggaactggctgacagtttaccttctgattctaagcctcaaaattactgttatggtgggaatgtgttcttccaaaattaatgctgaagcctaatccccactctggtgattaacagatgaggcctttgaggaggtgattaagcctcaagggccctgccctcatgaatggaattagcacccttatgaaagaggttgaaagaaactgccttgctccttccaccatgggaggacacagcgtttgtctcttctgccatgtgaaggctgagcaacaaggtgctatcttgaaagcacaaactgggtcctcaggatatagtaaatattttgaggtcttccagcccctaaaactgtaagtaataaatttctattgtttataaatcacccagcataagatattttattatagcagcatgaatggactgagacaattacttagtttaagtaagaatttcctatcatgtttccagtgctcaagagttagttttggtttcctgctggctcagaaatcttgccttacctcccctttaatttttcaaagtcgatagatttaattctattagaatcaataaccctttcacgaaaaggatgttttagttacactttctagtttgaggtaattgtagattcctctacagttccaaaaataataataataatgcagagagatacccagatcttttactctattttcctcaatagtaacatctttgtaaaaccatagtgcaatatcacaaccaggttattgacactgatgcataacatttccattatcaggaggacttctcatgttaccctttcagagccactctctcttccctcacacctccacctccgtcttaacccctgtataagtgatttattctccatttctacaattttgtccttttaggaatgccatataaatagaatgtatatatccttattagactggcttttttcagtcagcataactttctggggattcatccaggttgttgcatttatcaatagctctttccttcttattgttgggcagtattccaggatacggatgaaccacagtttgtttaatcactccctcatcgtaggccatctctctctctctctctctctctctctctctctccctccctccctcttttcccccacttcattgcctcctcttctcctctctacctctccttctctttctcttttgcatagggatatctaattgttcaagcaccatttgttgagaagactattcttcctccattatattacctttgcttctttgatagagaggagttgctttgatcttttctgagctatccattctgttctgtttctctgtttgatctatttatttattgcttcaccactcccacactgccttcatcattgcagttttttagtgagtcttgatataaggtagtgtaagttcactgtattaacccattttcacattgctataaataaatatccgagatggggtaatttatgaagaaaaagaggtttaatggacttacagttccacacagttggggaggtctcaccatcatgactcaaggcaaaggaggagcaaggtatgtcttacatggtgacaggaaagacagcgtgtgcaggggaactgacctttataaaaccatcagatcttgtgagacttactcattttcatgagaaaagcacagaaaagaaacacctcatgattcatttacttctcaccatgtccctcccatgactcatggggattatgggagcaagaacccaagatgagatttagatggggacagaaaccctatcatccaccaaccttgttctttccggtattgtattgacgatcctaggtcttttgaatcagtatggaaatgtcaacaacatattttgctaaaagtttgactgggattatatttaatctataggtcaagttgtaaatattgacatcttaacgttaaattctctattatatgaacacagaatatttctcttgttaaaataattaaatgagaggccattagactgcgggagcttcagtgcactcggtttctacataagcaaactaaaacccaactcggtttgaatggtaaaagaaaactttaaccaatcagaaaccaccaactaacctctaacaagggaatggaatgattcgaataaggcttatactccaccttaaccaattagatgtttaatttgcctttcttccattttcaccctataaaagccttttcctcgtgcctctttgcgtgagccccaaaagacttgtgatttggagcctgcccgattcttaaattgatatctgctcaaaagaaaactctaagatttttatgtgcctaagtttattttttaatacttctgttgtcagaagagggacccaaagaagccctgataatggttcctgggacaatgagtagccagatgtagttaccagctgagccggttttactcaccgctttctctctgtgtctggatccagcagaaactggactgggtccaacagaaggtcttaagaaggtagggtttagggaagacaaagaatcatgagttcatctgtatccaggtagtctggaacctctccatctgggactctagctacgttcatgtataaaaattatggacccagaacctgtgtttttctaaataaatgtgtaaactttactaaagacaacttaggattacactggtcacagtgaagaaattttaacctaaacagttattcatctataagctacattgaaagagaagtgatcttaaatgcctcaaaaaaaaaaatgagatatgtttttaataggcatgcagaagcttctaaaagactaagcaaatcaaaacttgcctttcttaaagactctttacaaaaggcaaattaaaagcttaagcacttaatcagtgatgataaaaaattgtacattgactcactcaactctcaatgctccttcttttcctcctgtctctcttcttcctctgcctaattactctgattccactaccctcttcactcagctgcctttctactctgaagatgagaagcaagttaggaaaatgccttctaaagttagttcctcagatcaactgtgtctgccttctttaattacctttatgtcttggtcaaaatccgaactgacagaaatagtgaaagacttccctaacccaaaggaaaacccccaggaatttgctgaggaatttagaatcctcatttaaacatacaatccatgacttcctgatctttgtcaatttatccacatgatactgggacctggtcaagcctgcaaatggaggcgatggttgaatgggactaacctgaggatgatattaaggatcttatgtctcagacagctgcaagggatgaacaaaaaagaggcaggggaaaaggaagcattctataatcttataagtaaatctcatctttacctgagcctgtgtgtccctgcactgtgactgtcacaagaacttttttttttttaaatctctgtcaccaggctggagtacagtggcatgatcttggctcacttcaacctcctcctcccaggttcagtgactcttctgcctcagcctcccaagtagctgggactacaggtgtgtaccaccacacctggctaatttttgtactttttaagtagagatggggtttcaccatattgggcaggctggtcttgaacttctgacctggtgatctgcccaccttggcctcccagagtgctggggttacaagcatgagccaccgtgcccggctctcaagaaattcttagctacccccatccctcaagtgagacaggaaggtcagatggggctggaatagggaaacgtcttcccctccaggtgggatatggctcgagtaaaattgtttttcctgcagaggaggaggctttggttatggggaatcctctggacatgtttcacaatatcactcttcccttctcctttcagggcaatgagggcttccattctggctcttcaccatgataaccttgggggcttcctggatttaaaacccaggaaagcaggggttgagaagggagagcctttgaccatggtctctagcagtttttcactctcctaaatgtccacgttcagcctccagcaagttgtcgaaatcaccgtaagtgttcctgctagttcatggtttcagagcttccattccaggttagctcatctcagctgtgactccagatttccacgcaatgggtttgcccggagccctcagttccctaatgggtccaagaaaagtcattgatttttccatttatttggcttttttttttcttttttaaaggagtaaagtagttactttcagtctttttacttgtagcgaccgaaaccagaactctgaaatactttataaggactcagcaaataaagcttttattatttttttctcctaagaagatataggatttcttttgaagtttggttattcagtccctgtatatgaattactttttttttttttttgaagaattgctgaatatttattatcatcagaatttttcagttttcttcagaatcctggtcacatagatgaccttgaatattggctgatgtttttcccttgaagctcatcatcaaaaattactaaagcctgacatgtggcaggctaggagggtcccatggatcctgcacatttgtgcttgctgtgtgtctgctgtgaggagagtatccgacggcctctacgtgctgcacgtttgtaacctgcggcaggattcccatggctaccactcttgccctggctgcttccaggcagtgaatgagcacaatgtggactagagctgggccatgtctgctggtgtaggacagtctttgccctggggttccccactggcaatgctgaaattttctgcactgtagtctgaggctcccccgactccaaaccttttcacaggtgttaattgacatcatgttctgaagactttccctactcaatcttgctccctctccccttcatctttttgttttgaatttttattttattttatttttttcagagacaaggttttgctgtattgcctactacactggagtgcagtagtgccatcatagcttactgcaacctcgaacttccgggctcaagagacccccctgcctcagcctcccaagtagctgggactacagggacacaccaccatccctggctaattttctttttgtgtagagtcggggtctctctatgccgtccatgatggactcaaacccctgagctcacatgatcctcctccctcgctcagcctccccaagtgctgagatttacaggtgtgagccactgcgcctggctcccctttatctttcacaggcatttcccaataaatttatttcctttctaattcctgttgataaatgcttcatggagcacccaaactggcatagtttatgatttctgatgttctattctatttcgttactgtgaaaggagacctggttttccatcacattctcccctaagtgagaactctggggaagacacactgactgctagattttgcttaggatgtgcaagcaacgtatgtctgtcaggctttgtctaatctgtgttctagaataaggggagcttattcgagaatgtcaactttcaagattggacgtttttactttctctaaagtacttcattttagagaaatgaagtattttttttttcttaaaataaaattatctggtgttttccctaagggcaaatgccaggagcatatgctctatatgttttgcctcgggtggggttggggttaaatccagggagcatacaccccgggttgagggccaggcgtatgctctctggaaggttatgttttatttgaagccattgttagaaatacagcattctcatgaattgtctccttttaacctctcttctcattcttgtcctccttttcacctaagccctaagtgagcctgatgctctgtggttacaatcccacccttggacaatgcccgccatcaagtattccttgttgtcacttgtcatcctcatcctacactctttctatcacagaaatgtcctgggacctttcacgcatttatgacctccccacgctccatgccattcttctccttgacattgtatgtttgtttcaatgtttacttcagagaggtcttgggggctatggacttcaattccattagccacatcacaattttcaacaagaatctcctgactgaaatgtactgaaatggaagagaaagtcctctcaccagaattgaggaatgtcaaggctggaaggtatcttagagatcatctaatccagttcttgcttcagaaacgattcagggaagcaagtgaagtgacttggactttacctatggtaatactctctccccaccctcaacactgcccagctggcatttctgtagccccaacacctcccccacactgtgccttggtgagtgttcaccaaggaacgctgcattttgataagcctcagtaatcaagagcagcctctgcccataaatacacctgccctgctcctgcctggggtgattccctccgacttgcgtctgcttctcgccagcagccccagcattatgcagagacttgtgctgctattagccatttctcttctactctatcaagatcttccaggtaaaaagggactctcagctggaaatatacacagttgctggggatgacagggggagaagaaaaacatttgatttagaaaataaatcctgaaggatggagtaaccttcttcaatctcagccttttttctctttgctttcattgggtccattagtaaaatgcagtatgtggcagtccttgtatgcaccttacagccacgaggcttactagctcaaggaggaaaaaagaaacgtagggatcaggagtcctagatgtccttggcaccctggccacacacggtaacaattcctcatggaatcctcagcaatgaggactcactagccatgcttgttccattgcagggcaacagcaattattcattgttgattttgtagaataagatgccttcccccatcctcctccttctgaacagctttactctgcacagaaaagggcgcctactcatcctcctaaattttgcaacttttcatatcaagtcagatgattagggttaaaggggatgcagtgatttcagtaggcaagaacgtaatttactgacaacacaaatagcaggtgcctttgaactctgctcaggaaattttagactgagatgtcagcaatcttctgactcctacgttaatctatgtccccagaagcatgtatttcttaatatatttgcaatggatatgagagagcacctaatctaattcccttcttttacaagctgagcagcattctctatggtacagtgagagaaaataagatttttagagttgcttaacaagtctagcagtgctgggacgaaaccaattgttttgactcgtagaagccatcggatcttctcttccaagctgctcagtcaattttatggggctttgacagacacccagcacccatctttttgcccttccgggctgtgcctccactgtgattcagatgggttaatgattttttttcagagggtacctgtttaggttaactcttcctttttctttcttcccgtgtcatttcccaaagacacttctgtgaaattctgctatgggcatgttccaggtctgttaaaatatgatagcaatttatcaaagaacaggttttcttcaacctttgatcccaagacaaagaacttgggatggaaagcctgggtcagggatccctccagatcccgaagaatgcaccgcagagctggctgccattatccacacttggctgcagagggctgggtcagactgtcctctgcagttgaattctgagaaagaccattagcaggaagaggattagggagggaagtggcagaagtgggtgagggtgaatgacatgcgctgcctgcctcttctcctgccacccctgctttgggtaagtttggctgtcacacactgtcagcccctcagatacccacagggactggggatgggtgctgtcaaccaaaaataaaattctaagccccctccccaaccatctaaatggactccctcctcagccagggctcttaaaatttaatctgaaagactgcttcaggccatgaaaggaagtgggggttggacatgcctcattacactttccatcatgaacatcaacacagactttaagtgtgataagaaacattttacagcctgttctctctgaagcctgctagctaaaagcatcaactgcatgatacaactttggcctccacaatacaacctcttgtcgcaacccaaacattcctgtctattgatcccaggtctttagacaaactcaatcaattgtcaaccagaaaatgtttaaatttacctatagcctggaaggccacctgccacacactcccactgcacccccacaggccccccgccacccccactttgaatagtcccacctttctggaccaaaccaatgtaaatcagccaggtgtagcggctcacacctgtaatctcagcattttgggaggctgaggtctgcagatcacttgaggtcaggagttcgagactggcctggccaacacggtgaaacctcgtctctactaaaaatacaaaaattagctgggtgtggtggtgcatgtctgtaattccagctgctcaggaggcggaggcaggagaatcgcttgaacccaagaggtggaggttgcagtgagctgagatcgtgccattgcactctaccctaggcgacagagcaagactctgtctcaaaaaaaaccaaaaaaacaaacaaaaaaaaaaacaaagcaaatcttacacgtcttgattgatgtattatgtctccctaaaatgtataaaaccaagcaagctgtatcacaaccaccttgggcacatgtcctcaggacctcctgaggttgtgtcacaggtgtgtcctcaaccttgacaaaataaactttctacattaactaagacctgagacctgcctaagattttctgggtctgtagagcagaggaggaaaattgcttatgcaagaaagaaactagtgtagtgtagtctaccctggaatgtatttattgcttaggaaatgtttattactcagccttagtgtatggactgcattctcccttttgcattctgtttactgagactgtaagacataccaactaggtttttcttccagctttgacacataagttgctgtgtgacgtcagattagtcactttccttctctgagccttcattcccatctctaaatagatggcctgtgagggcttgtttgaaactgacagtctaacattttaaaggttgtgttctcttcctagtctattcttcttctcccctaacgctaagcttcgttttccctgagcaagcatgctgtcctctttttcctcctctaactccaggttgtaaagcgacctgccacagatatgtcagaaggcacatatctgctactcaacctccacatactccctcagcatgatacacactgcagcccacctcactcctttcttcattgccttgtactgtgaccacaagggcttgcttttgaatgaagcctacagcaaaacagtctttcctcatcacccgctgtggggccattgcaaatattaacccctacaatatcctatccagcacatgaattggtcaaactgccttttagtcctcacctacatcctggacaaagaaccttgatacctaagcatcagaaacaggaggcttctctttaccagaacaaatgaaagacataaaaccctggtgcgaggattagcagcccgtttctgctttgtagaaaaggaacagatgcaacaggggagaaggacttaaggctaagatgaaattaggactcttgggccccgacctctgcaaagaggtccatttgcagccctgactctcctctccccagggttcttctgacaccctctcccaagcctggctcctgctgagtttgctagagaacctctagcaaagctctctccagcgagactctctcggtccaccttacgctgtcctccctaccatcagccttgcttctgggttttcctgatatctctgtaagatcctatcagtgtggcatgtgagataatgagttttacaaagctgctttcagcctcagagagcgcaccctgagactgagaagctaaatccatgtctcctgaaaactgctctgggccaacggccgaacaatcaggattctgctcctttctagtttcctcctctctacttgcaaccactctagtttattctggtctagtctatccaatcatttactcaccacgtccttattgagaacaggctatgttcctggtagcagttacacaatggtaagcaacataaacatgggcctcattgtcagggagctcatagttcgaatgagaatagcaaataacaaaatatacatacatatatacatatctatatctatgtctatgtttgtatgtatctctctctatatatgtgtatatatatatacctatatagatacatagatatataactacaacttgcgataggtgatataaaagaataacaaatgcatagggagaaaaaatacttttggggcatttgaatacacgaagaggacagagaaagatttgcccaatattgggaacttaaggttgagacataaaagttcaaagaattcacttatgggaaggaagaaaaaccttccaggcagaggggacagtgcacgtgaaggtaccaggatagcaaagagtaagctcacacggaacagaagggaagccggcgagagtttcatggacagagtgagggccacagtggaaaagcatgagtctgaaaaagtggcccaagatcagatcacgattgctttggagaccaagtaaggggcttggagagatttaataaagaaaacaatagtaaacttgtagggattttgaaaataagtgtgacatggaatgatgtacattttcaaataaaatccatgctggttgggaatcagaaggtcaagtcaatcatctaggaaagtggaggaggatgggggtccaggaaaacctctaccaccatgcactagcattctctatccccctccgaaaacaccttctaccaaagccttgccttttggtgccagtaagcaattaatgacagtgccatatcctgttatctagtgagaagcgaatttgaattggacagaatatgtggttatgggactgcccgttgccggaagaaatgtcgcagccaagaatacagaattggaagatgtcccaacacctatgcatgctgtttgagaaaatgggatgagagcttactgaatcgtacaaaaccctgaaacgcagtagtgctggtccctagagtcgctggaagtaggacctcagtagctttccttcctgcggcctagcagcaagggcatccccattgcaaccacgggttcagttatcaaagaaggtttgctgagcttccactcaatgcaaagccaatataggagattgaagaagaatacaggctggaaagccgcctctggttgtgataatggagaataacaatgggagttaagcatgagtttcaacactttataagttgaacaaaaaatatgtctacctaatcagctataaacctaagaaaaacatcatttttatcctgataatattggttttcttttccgatcgaaagttttgctcaggagttatatatatcatgtgttaattaaaatgtaaagtaaatcaatgttaagtgtgccttgtttagaatacactatatttcaaaacatagacctctgaggagaaaaacaaaagaggtgatgtgtgatgacaagcttgggaacccattggagcttaaggggttgatcaagtgggcgtctgtggagggtcccatccagcagagggcagcagagagcagccctgcgctgagctgtggattcttgatcctgaaaacctgtaaagaaaggtgagtgatgaaacatttgacctgcctgcctttcctgtccaaaccaaattttaaggtagtcaaaagcttctctcttcgaaagcagcccagctaataaatgaggagtgtcgccattttgcaaacacatagggaaacagggatctagccaaggaatgtcaacagcgattaaaataagccagaaagacaacctgctaccctgtgcttcctaatagaaggacataatgccacgtacgagcttctagtcatggtaagcagcatcatcctcaccttgtcagggtggaaactgaggctgcattgtgccctttctaccaaaacagtgtaacggcccttcgcgtaggcatcgcccagcctcaatatgtggttagtcttgtttcatcccttgataactctctcctagattatctcaaataaaaataaattatttcaaaggtgcccatttgaaaatactctagaaggtgtaactcagggggaaagaactcgttttgtaaaatagaaccccaatactattatcacccctggaaaaaatcagcattcattcctaaatacaatttaacagccaatctgtattcaaatgaccctgagcatttcataagtgcctttttaagagttgatttattagaatctggatcctggaaggtccacatactgcctcaggttgtttacctccaaggcctcttgcacagatggtgatgtgtacttctattccatctataaaatattgtgctgaaaattgagtgcatatctgggcaagcccctaggtctcaacactgcaattacaggaaaagaagaaactactgaaccacccccaaggatgccacactccaaatgcaacatacagaacacgctataagacaatgtgacatttattttagtcttacatttttttagactcttttcattattctcatattttgtattttataaaatacttttaatacataatctcctttgatcctcaccataaactcttgaattaggcatggtaagtgtcaacatcctcaccttttaggcactgttactaaggttcagacggattagtggttttcctaacactggccacgatattaggcaagaccaggcctagaccccacatctcaagtgcagttcagaggcagcacagcatggcatgtacaaatacgcaaagcctggaatcccagctctactgcttagcaggggaccttgggaaggtgacttatttgacttgtaccttgatttcccctcctgccgtatggccattctgcccaacaacacttacaaacagagatccaactgctgaccctgtgctacaattattttttgtctccttttaaaatgtaatttgatgccttgccaaggaggccatcttgtacctcccaatgtaaatatagagcaaagcaagggacttctacagactttaatcaacgccacccgccgtagtggccagagagacaagaacaagcagaaagcaaagctatctcattgtcagataacgtagaaagccttgtatcgtggtcttcactgaagagccctgggtttggcttgccgtcctggtgtcctattgttttgctctctaaagaggctggattctgaaacagcgccccctcccgccctcaggtgtaattcacatagtcatattaatgaactgctatcctcagcacttaacgacatcacaaagtcgcactactttaatttcagggctttacagtaaaagaacaaagatagattgttctattttattgtttccagaattggcaggaaatatttaataatttgtacctgatgcactacaaacacaatcagaaacccaataacattgctacttatcttctatctccaaaggatggatacagatctgaagtctgtagttcataatgaatgatcagtaaccctttgaaatgtgcctaatgaaaatcaacagaaggaaggattgtttggatatttttcactttttaatttatgcgttttttattatttgaagttgagagagagagacagagattgacagagaaaatctctgggtgagcaaatcaccacccaggtccttatttaaatatccaaaagagcagaacttgaaattttcaacgtgcaggagttaaggttttccacactggcatattctctttcttgcctcccaagagacatcccattaaatcctggaaaatatgactgtgtaaaggggaaacatattgcagccaagtctgtgctcagaagttgctatagaatcaactttctcttgcattaccacatgacccaaagaaaattagcctggaagagtctcacaggtgagtgaagcagagattcctatgtagattttcttatccctgaattttagattgtgatatgtccacaaggactgctgggacctcagtttcataggcacagagggccctgtgggtaaaaataggtggggtcctgagtcttcccaacatgacaaagtcaaagacagacacatggtgagtggtagagctgcctttgtggctgaatccgagagaaaaaaatggtcaacctctgaggactgggaaggggctgaaatgctttccagttatgagaaattacacccaaaataataaaagcatcatggcaccgtggagaaaagatactattcccgtgaaaaactacatttcttcttatgtctgtgaccaccatgaactcctgctcttccccaaacaaatctgttgcctttccctttaactttgagcacccctttgtttatttacatggactccattctgttaatagtgtctgcagtgcatagcctcctccagatctttagtctttaattaacacatatagacacatcgctttttcactcatcctccatttcctcttcttaaaatattggttaggtctctaagacagttttcagttccaaaatgttatgattgtttcgtcagaattgccaacctcggccaggcagggtggctcacgcctgtaatcccagcactttgggaggcagaggcgggaggatcacttgaggtcaggagttcaagaccagcctggccaacatggtgaaaacccgatctctactaaaaatacaaaaattagctgggcgcggtggcaggcacctgtaatcccagctactcaggaggctgaggcaggagagtcgcttgaacccgggaggcggaggttgcagtgagctgagatggcgccgctgcactccagcttgggcaacaatgccagactccgtctcaagaaaaagaataggcaatctcaacagatttatttaaacttataacaataccatgtttttattaccaaaactaaatggtgtttatgccttagcgctcatgaaaggatttcctgtgttctttcatatgctgccttaagagcattcttgggatggctgaaatggctacagatcaaatcgacttctgaaaacacaattcattttgtgattctgtgcatgaaaaagaaacaaaataccaaagaatatttttgcacaattctcaaagctacttctttaaccacgatccaaaagcagttttctctcctatcatgtaattcttcctgactgctttttccaaagaagactctaatatttgtgtcttttccatatatcagttattttccctagaggggaatctgtgcctctgttaaatggcattctagttggtcttacagactggttagcatgttacaatctcagacttaagaataagaaaatctgcataggaatctttgcttcgctcttctgtgagtctcctccagagaaactttcactgggtcatttagtaatgcaaaagaagagtctaaatttgattctgcagagaacttctgattccaaactgggctacaatagggttttccttctcgcattcatattttccaggatttaccaggatgctacttgggaagcaagaaggaggatgtgccgatgtggaaaatcttaccccctgcacatgtgtgcaatttccaataagatccttcaggaatatgtatttgcagaacttcttatttgacaataaaatcttgatcattttactttagcccacctacttagtccaaacgaatcaagataccacatactaagcagcttaaaaaaaaaagaatatgatttattgattgaatggaccaaaaaaaacttgaaacaattattagaatattctataatgggttctgccatcctccccctcaggatggatgtggcttttagcaagagaattattcaaagatttttttaggacacagaaatctggcagaagaggacaggagctgagagcattgttgtgttaggacagatgtaacattaattgcctttattacgacttcaccagcttttgcctgtcaaagagcagaactaggctttcccggctgctcttttttaagattgttcttttcagaagcatggaagagggggcttactttatctcaagacgtagacaaaggaagtgagatctaactatttttggctcagtttcttcatttaaataatttcaaataattctaacgacttcaaagaagattccgttacctgggtggtaattactcaaatgctgttatattttaagtcatgattttgattaatgattcattactatgaatatctgaatggtggaataggcttgtttttgttttctttccttttatagagaagataaaaatatatagaaataagttaccaatatactccaaaatttccatcactgttataaaagatccacattccaagtttaaataattacaaatacaactgtaagaagttgctattgaactagagtataaaaaatacccagagtatgtagatgagcgaataaatcttcatttagggttgaggtagagcagctgtctacctcctttcttgactgtctatgttcttccaacatccaattatcagaatttgatgcagtaagtgattaaagaaacttatcatgggccagttgtcacctatctccgcagtgttgccctgtgctcttggaattggaagacttcctaattccttaaagtgaaaggatgtgaatgatgctcctgctctccctgaccagcacctcatgctttgcagtggagaatctgtcctgagacccaaaagatagtggcctccgcattgtgctgccagggcagctgctatgtgcaactgtccgcagctgcaaaccttccgccctttgctggtgcttcagcggatgcccaggtctctattgtcattgctgcctctttctccatttgcttccagctttctccaggtagagagtaagtatttttatttacacaaatgacctaagttgttttctctgtctggattaaaatatacatgcaaatgagacatatgagataagcactatcttttccagacatcactgatgttacattggatgctatgtgaatacaaaactcttcaaccaaagccttcttcactttagttaagtccagagcagactgtctgggttacatgcatacctgagctaatgcagccaagtaagaaacacacacttggttaaaatgcttaaaaagatgaaggagaagggaagacaagtcctctgcttggatattactagaggagaaaacccagactcaaacacagattttttttttcttttttaaaagaattgaattggacccagtgacatcaacaggaggtgtctgggggtaaagagaatggaaaggggagagaaaaatcaagacaactcaaataagttaaaatagaaaggaggggggtccaaagtgaggaaggagaagtggaggggaccaagaaacagggagagagactcagagaggagaagaaaaagaaaagaacattttgagcagccttggaactctctgtataacttcaggaagggatagtttgtaaaaccaggtcctacctgttatgttgtgtgtcttatgcatgattttttaacactaaaataaaaacgctcagccaacaggatagaatcgacatggcagtttatttatgtccctgttctcatgaacattagggggcttttgagaagcgtttgaggacattggcaactttatgatagttatgtttgttctgcccctccatgcctttcatctttctgtttctctctgttcttccttattcaccaaacccacccaaggcattcaggcgtattatttacttcctgaaatatgtgtctcaagtgtttgttccaccagcagtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggtaaaatggaaaggtgacccgggtctgggtgccagaatctctctgcaatggtcatctgaggtatgggagtccaggctggacagggagagatgaagtccttggggcatgtattcctggtggagctttgggtacgagtctctgaactgggttcataaatggcactctgaattggctgatggcacttgcttcccagggaagagtgtccctccccgactccattttcttatccttttaacattcccctttcccttacagagaagaacattacattttagggaatcttaacaactgcattagtgacacttgaaataaattctctggctgtgctggctttgaggaggtgctcagactcaccattcatggcatacatttcttacacttcattcaccttctctctctacacataggtgcatacaacgcatgtgcacaaatgtgcacacacacggaacactagcacccctcccaactcccccacccaatcacccatgctcactcacctggtagagtgtaggtgcctcatgctgacgggtctgccaggcggaggcctcagagcatccgcagacgtgtgtttccacttgcacaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggtgagtcagggaccaacacgtgcaacaagtgcatccactggggagacgtagagggaacaaatagacgggaagatgtctgtgctggtcggggtgggtgagcagtcattgtttggggaagacatggtgcgggtgcattgggctgccctgcctgtcagggagaccacggggtctcacagcttcccctggggctggatcattgagggccttgtggaacgtgggagtattgaggggccaaaaggcaatttatctgaagccacaccagtaattgctggcttcctccaagaacaggtgccagaggagacactggtggaaacatggcctcctgccaggttgcagccccatgcccttagctttggaggtcgttcccgttcaaggaatttactgaatacctacctactaagtttcaggtgtccattgaggtctgggaaatgcttcctgaggatgggggcagagaatagactgtattgtcagtctactcaggcaaggaggtagcaggacatggcaagggacaattgagcccacagccactcttctggactcttccagaagggccaggcttctggtcagcccccaaacccctgggcaggaccagcttcaaatccaaaagggcctggaagagcctgtagtttccaagatgcttctttaatgccaagctgattgctgaccctaagacagggagaactaggttagcagatcagtgggcaagagcaagaaagacaggagggtgttggcaaattgctgtgacatccagcaaataaagtcctgctgaatttgatgcctgcagcatcctacccaacctcccatccctttctaattggcccacagttccaaaggactcattcatctggatctcctcccaagggaagggaaaaagaaaactcaattattacacaacaaatataaacaggtgcaatagtaggcgtgtgttatttagtctaacagtattcctgtgagacaggattattccttcctttggttaaaggagatttagtggggcagagctatatatctggagttgatgttttagtttggaacttgaagctattaactatggaaagctgtttcatatccatgccacccccaccctgtccctcacggctcaaatgaccactgtttgattctggagatggtcttaagaagctaatgttggattttttctttttttaatgcagaacctgcatcagatttaaaagttgttgactgcaggagaagtgaaggcttctgccaagaatactgtaattatatggaaacacaagtaggctactgctctaaaaagaaagacgcctgctgtttacattaaaactgatgttgctgatatagaaacaaagctctgccacttacctgttctccggggccacgttgtccaatcaggtgcaggttttttgcggaagtgtctgagcagcagggagcggagatattgccacttgtgccagacagttcaaatattttattgtggcaagataaatgacaaaaatgctacctgtgatcttacagaagatgacttagcttgacatgaacagaattttcaaaatcacacaatttgtgctagtaaatgtggatatcataaacttttattagaaagaattaaaataatttgttcttttatttaaaaactattttttgaatacctacttctattctaggtactgtgcaatggagtccattctattctaagtactgtgaaatgtagttgaggtgtcaggtgtgtggtcaaacccattctccatcagccccatcatctcctacctgcaggccagttcgaagccctgttctctagcagcagctgagagagtgtgcaggcaaatgccttctggggagatactgagagctgggagttactgcctgttctctttgtgctaaacctggaagaataccctctggaagtcctcttgtgcccctttaaaactacccatttgttctctgtggccttagaagacacaaaatgcagagacccatttataacccgatggtgctgtgcaattccaggcttttggtgtcctgaacaaagaactggatgtgatactcagacagcaaagcaagcagcaaaagtgtgtgaagcgcagtattacattcccggagaggggagagtgggctgacttctgccaaatgagattagcatggcttcggtgtaccttgggtctttttatgtgttttttccccttctcttcgcaaggctgcctgatcttttgccggtgcctgccttttgatagataggtgtgttgcttagttactttagcctgtgcgggcttgtgaattgtctccatcccataattttaactacatgcgtgataggtagtccatatgcatgagctttaatgagctgattatcatacagcatcctgttaaggatactttttctctttaatgcgcatgcctatctctgaagagctgccccttcctggtttgatctggatcttgctggccatggggtccttgctctcttctttatctcactttttcttttggctgcttcacttctgccttttatcttgcttcttgctcacccaccccttcaccttgcttctgtttctgcttttattcactctatcctttatccaacttccaatttcctctgcaattctcctgcctcacattaacttctagagataagtgatttaggagccagtcccccaggtggcagctataaaactgtgcttgaagtattctccttcaagggagaagctggagacctggatttcttgctggagctagtcgagaggagcaggtgcagtgcctacctatacctctgttcaggctcccacaggtctactgttcaccctgcccctttggctcccagatacagacccagaagtcaaccctcaggcagcagatgggaaaatgggtagataaaccccttgcaggtagaaaccgggaggtgggcatttacctgcctgctctggcctgagcccagggagagagctgccaaaagtgcttgcaaatctgtgtcccaccatctctttggtgtctgtggtttagggagacctgcagatgcccagctctatcaaccctgagctgggtgatttaggagccaaacccctgggtgggaagcataaaggtcagggtactatatgtgtggtccaaacccttcactcctcagggagaagctaggagttgggacttccttaccaattaattgtaaggtgttatgcctgggatagggattgtgcggggagtgtgtctcagctcttcccacctgttttcacatgaatattttctcagttgcttgatgtgtagtagtcgttcaattagtccatggttttctctcagaaagaaccgatctgtgtgttgatatttctttggtatatccgtggaaggaaggaaaggctggagcctcttagtccaccatcttgcagatatcagtctggcacacccttgattactgtgtagttgagcgttttttcttttgtttattgatcattttttctcttctgtaaaatttaatagttttactgggttactactttattctcttttttcttttttttttgagacagagtttcacccttgttgcccaggctggagtgcaatggtgcgattttggctcaccaccacctccacctcccgggttcaagcgattctcccaggttcaagcaattctcctgcctcagccttcctaagtagctgggattacaggtgtccaccaccatgcctggctaattttgtatttttagtagagacggggtttctccatgttgatcaggctggtctcaaactcccgacctcaggtgatctgtccgcctcggcctcccgaagtgctggaattacaggcgtgagccaccgcgcccggccaggttaccgctttattcttatccatgtacatgtgctccttttatatctaaccttacatattctttcctccatcaattatcttccctttctctggaatgcctcctgcttaaaccccagttatccttgaaatatcctctcattatctttcaaccataattttcatgcttttcccttttgttctctactttgcagatatttatttttatatctgtagagcccttctattttttttttttttttactatttttggattttgaagttcagttattagatttttaattatttttaaatagtcttatatttgcaaatagtccctttctttctcaacgtgtgactttctcatgggatctaattctcattttgctgaccacagtttctcaaatctcattaggaataaatacatattgattgttttaaaactgcatttttccattgaaatcgcacatattccagttcagttaagtctcttccagtttctaaaagtgctgacttcacttctgctagttttacactgaccgctaacatctgcttgctcatgcagaccagctgtgcaggattgctttggtagggtaagcaagcgagtgagaggtggcaaagagtgaatgtgggtagaatctgctgtttgtcttaaacttttctgtagggtatctctacttaaaagaagtttcatggatgtctttaataaataaatagggaagaaataatgatatttgcctaatctgtccataaaatcttcatcagtgatcattattttaggctcaagttaattaataataaactgcacatcacaaaactttgagctcattattctctttgcagctttctttaatccccataaattaaaacttcctgcaaatattgttatgtattagattgctacaaaagtaattgtggtttttgccattgaaaataacggtcaaaaccgcaattacttttgcaccaacctaagtataagcatctgggtaagaatcaggatcctggggctcagcataggaaagaaactaggtacacagagccctttacagaatgccacctttccaggctttttttctgaacaaagatgttccttaatcaacttatgtatgggcacactcacacggggctgatacccacggataatgaaggtatatgaaactagtcctcacatacaaaaccagaagcactggtaacttaaataacctctttgtaaagcaatcttaatatgtatgtaagatataaaatactcgttctcattgtttcagttattctgctcagaaattatcctgggaaataaaaaaatactttgagaaaccaaaaaaaactctaaaaagttcaaaatggagcactatattagcaaactacaataaatctactcagagatattacatattccttaggtataataaatataacacagtgaaaaaccatcaaaatgcataacattttcaaaatacttacatgtcctaaaaattatgataccaatgttcacatatttgatataaaattaactgtgaaaagtatgcttaaaaacaataaagtttctaatgttaaaattattggtgatttttagatatttgcacctttaaaaataccatcaagttattgcattactcttaaatgttaaatatacatttgtaagaacaaaattaatgtgcctaaaaataaacatatatatgtatatacaaagatatcacttaattataagcaaagacattctgttgtagacttaagttgcatccagaaactcacagagttaacataagaaagcacttcctgggcagtaagatgataagactccttgtttgcatagcggtgagtaaaaataaataaaaattttataaaaagatgatatgacatttaaagcatgttacccagggagattttggagcctacctgggattcataaaaaacaggtagaaactgatttttttttcctctcattctttgatattataatatttgcagtgctgggttgtggacaaggggagggagagcattaggacaaatacttaatgtatgtggggcttagaatatagatgacgggttgatgggtgcagaaaaccaccatggcacatgcatatctatgtaacaaacctgcacgttctgcacatgtatcccagaacttaaagtaaaataaaataaaaataaataaaaattacagacgttaaaaaaacaaatgtgccatcctgcttggagacaactgaataaatataatgggttctcaaggtcagtcctgagccaccaattccgttagttatgcattctttgttctcacagcagctttttagtacaggcccctgagccctgatgaggttttatggccaccagttttacgcagtgggaagaggtccttagacagaagcttgctggaggctgtctcagaacgcactgcagcacacctgactgccttgtattccactctgcacgcccaccttccgcgcagcatccttccctcccctgcaccccagcagcttttcccgggatttgatccttctgactcatccattgctcagagagtccccatcatcaggaagcctgtcttctcttcaatgcctgaggtttgcggggcaaggaacaggtgggcaggctcagtcaattccaccccattgcacctcgtgtgacataaataatgggcgcttctaatcttttcttcctgtccctacatgtggtcgtcaccgcaactctgcaggcttgacctgctctcacctggcttatttttacctctttgggtcatgggaaatgaccttctgcacccagggaatctcccttagttgataagaccaaaatggaaataaataataagaccaaaatggaaagttagtatgccttcataaagagagattaaattcatgaacacaaaccctgcctctttcttgaaaacccaaaatacataaataaataaaacctccggagcaagaggagtaacattagcattgtccatgaggataaaaaagtggggagaaaccccagctgactttttcatcatcccaaaaggagacaccagtaagcagccactggatttgccagctgtgcacatttcatatatatggaatcatacaatatgtggtattttgtgcctagcttattttacttaatgtgagattttcaaagttcctccatgttggagaatgtggcattacttcttttccttttgtgactaaataatattgcattgtatggatgtgccacactttgcttatacattcatcaactgatgcacatttgcattgcttccaccgttgacacttgtgactaattctgctatgaacactacactcatgtacaggttgctgtttgaacacctattttcaccgcttgtatgtatacacctaggagttgaattgctaggccatattggtaactcatattgtttaactttctgaggaactgccagacttttccacagcagctgcaccactgtacattcccagcagcaacatatgaaggttacaatgtctccacattctcaccaacacttgctgttttcaaaaattttgttttgttttgtttcattttgagacagagtctcgctctggcgcccaggctggagtgcagtggcccgatctcagctcactgcaacttccgcctcccgggttcaagcgattctcctgcctcagcctcctgagtagctgggattacaggcacccaccagcatgcctagctaattgcccggctaatttttgtatttttagtagagatggggtttcaccatattggccaggctggtctcgaactcctgaccttgtgatccacccgccttggcctcccaaagtgctgggattacaggtgtgagccactgcttctgaagttttattttttttatgactgtcctagtagatgtgaagtgatatttcattgtggttttgatttgcatgtttctaatgactaatgatattgagcatctttcgtgtgcttgctggtcatttgaatttcttctttggaaaaatctatttaagtcctttgtccatttttaagtgtgttgtttgtctttttgttgttgaattgtatcaatattttttaaaatatagaaacattttttctactatcaaatgtttgcaaacccaaagttatctttcctctcttctccttacactcttcttttccattcatgagtatgatgcacatcagaataattagcttgtgtgttggcacaaattgaactctatttcctttcaactctgcaattatatgaacctatgaacctataaccagatattaacaaaattagccaataagcgtgattttctagtttgatttctttgaaatgatatgccttattcttcagaattatccacaaaatagttccgtggggattgctttctgggtctgtgatttgggaatggattcaagtctggaggagaaggtacatgataaaatttaatactattaatttatttctcccccaaatgaatttattttccaacatagtttattgtttccaaactatacagaaattttctaaactataatttcacaatgatttgattagtaactgtactgctagaaaaaatatgccatccacatttaccttggatcctttccaaataacgtgtagtataaatagaaagaatgaatgtaaagtataaaatatgcattttattgttttatctataagtcatcttagtgacttttaaaaaatgactcaaatttttgaatatccacactcagtgtttttatcaaacaatggttcatgtatcgtacagccactttgtccatgcacaggatacattcagaattgtcattattccttgggacccttgaacttagggtatcatcttggtgtggaagccaatttccctaaggggcaaatgaaattgcttttctttctttcttttttttttttttttttttgagagatttcagagatgtcttcagaacaaatgctccacagagaaagaatttcacattttaatcgatttcttaaagtactgagttggaccctcacaaatattcataactattttacaattacttagtacatagctaacatttaaggtaacttttttttttctctctttttttttgatggagggtcaaaagcagcttggagtgcccaattttccctaaagtcttaacttcgaaggtgattttgcaaggtacagaaaggtctgtgagtcagagagtccctgccagggcacattgtcctgcttaatctctccagaggtggaaagttcaaaatgaacacccagcccctgcctctttgagatgctcacactgttcacccatgcagaaagtccaagaccactgcttgatgtctctttttcaaaatccatgtctaggtaagactcatggtgagatatggttgttgaggctggttaaataacgcagaagacagcttgcagaaaatatgatgtgtctaatctgaagaataacaaggctctgcaagctataacaagtaatataggcaagtccagaatgatatctagagtctgctattgcttacataaaaatggggtatggattcatctctgcttccatacacatgggacacctctggaaggattaataagaagctaacagcaattgttatgaagcccagggggataggagagaagacatccttctctcttgccccttttgcttaagagaattttaagggaaataaatctaagtgatcctgggactaaaatcaaataggggcaaaatgtgcagctttatccactgtgtgttttaataccacacattatataaacccacacacaaaaatatcgtgtccttgcagattctgttttcacaactcccagcaccccagagcccacaaacctccctccagcccaggatgacacagccctgtggttgccgggggctctctgcatccctcactagactgtcacctccgacagcggataacttcatcaaatgagagaagagcatgtcctcttcctccaaagtagacaatatcctggctcttcataaataggtgaattttgccaaatttttggaataatgtggtacgttgtctctgttttttttttctttcagcatagcgtttgtgaggttcatccacgttgttgtacacatcttcttgtttttctattcttgttgtggtgtggaaatacattgtgttttgttgttgtcataatacactatttggttgcattctcttggctgcaaggaaatgtgctacaatgaacgttcgtgcacatgtctcctaatgcacgtgggcctatgtttctgttggtagatgggagtcatgttgctgggaaataagctaattatctgctcaactgtggtggacaccgcagctttctgaaggcagaaaatatatctttacacaaccatgtctctagcacctagcacagggcttggcactaagtagccacacctcaatgttggttcactttcctcttcaatatccgtatatggaattattggttgatccctgcttctctgaatatcaggaagccagtctatttttaggcagaaagggaagagtagtcagtaaccttctgcccacagccttactcagtagagcagataaatatgctcatgctgatcagtattcccaaaaacctataaatgtcccattttgtgccttctccgctccatttcattccatcattcatcatatttgtgctccttcacgggagggcagggaggttcaacggaccttaaaacatgaaggtcttttttctgtttgctgttctcttttgtttggtccaaacaaactcaggtaaatgtctcctggttagccctggggaaggtagtgcaggaattccatttatgtgtgtgtctgtatggacagtgtgtagatgtgtctgtatgttgttagtggatgcaggtgggccactgtggggctcagtcttggacaattttgatctcccctgtgaagttttttaaaagctaaataagtgttataaaggtcttgacacaagacaaaggggtatgcttgctctgatacaagtggcaagcactcactgcagtctgagaaaagttttcagaaggaagttatagtcatatgaatgtcagagctggaagggaatcagagattgtctatagcagccccatgctctacaaaaagaaaaccaaagtccagagaaagtgttaatttaccatggtgcaatgaatctttatggtcatagtaggtcttcaaacttataatattccccctgcttgcacatagaacacatttacagatgggcaagctgaagtgtaaccagttaaatgagttgtctaaggagacataatgagatattggaagaagtaagaccagaatccaggtctccacgcttccaggctgggggctcttctgtcttgactaaaggtggaccccccaccttcttcactttgctgtctcctccaagctgtgacagggctgagatgatacagaatcagggattagaccccgtttggaggttggatgttgtgcaagagtgttttcctaatcacgcaagaccaacactgtgctgttgttgttgttgctgctgttgttgctgctgtttaaagtcatcgtacgtagcatttgcagatctgacataagtaagatctttctttcaaccatctcttgcccaatgtcctgttgttataaaaatttaggtggtcatttgtgacttacaagcccacaggtcctggtgaggagagaggttttattttctccttttcgttgtaggacataaaactaaaaattgggccataagttgagaatgggttaatacctctaatttccttagagaccaagacctgtcctattctggaccacttctgttttccaaaactccctttgtttccttctagtgcacatctctcaccaggaggctcgaggaccctcatttaagatctgcgtgggctttttagggcctagatgggccaggtgagcattcataaaacacaccctatcatcctcctggcaacatttcagatataaattatcgttcctgttttaaagctaagaggccaaagttcggttaaactggggcttgtccaaaaatacttagccttgtcagaatatataacccttggcagtgggctgggttcatcttctattctctgcactatatgagttaaatgtcaactctcttctgttgtatccataggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttccttacttctccatgtactgccttttcaaaggggtctcagaattttgtgatattccactttcctttcctagtcaagggaatatctcttaagtatctggagatgggaactgactagaaaccgagctccaaactgattttcagagagacataaatgcaaccaatctgctgctctgttttccatctgatgacttctttcttacacacccagcactagccttctcctgcttattcacccagatggtaatgcaccttatcccttttccctttatgcgtcctcaagcaataacaccaacaggtcacatttcagtaggatagtgttgttttcaagcatttactcttaggctatttcaatttattaatacaacaagctgatagtgtgtataatagggggtaagcaggtccattttaggaatgaaagaaaaatgaaaatcatcaggtgaagcacatttcccccaggctagcaattcataaatggcattctcagtatgcctatcagccagcattcattcttctatgatccttctaaaaaacatatttctgtgcaattggagcaaggcagggcccctgttcatggagattcctgaatgcttagctgccttttgcctttctctggatcctgcttgaatttgttgaatactaattccaatagtagtgaacaccaattacaagtaaggaatttaaaaaataataaaaacaaacatgctgagagatagagaccacatgccaagctttttcctgactgacaggtggcttgggaagatgctctgtgttcctgtttctgtcgctgcctgagtccagtgtgcttctgaatgagctgaggtgctgtaaagagcccactagaatgtacactttggggctacagtctcaattcccagctcaagttgcaatgaatatttgtcatcttgcctttggcctctcgcaacctcttctaaactcactcttgttttttttcttttctaaatgcaatcagacagacctctggaagtgcacagagtaagtctctcttaggcacaggcaccgctgcagggctctctgtcatgcctctagaggggagagccattgttccatccctgaagggaatgacttcctgaagggcattggcccctattagccttggctgagagtgaaacgcagcaaacgtgcatgcctcagaactggcagacacgttctcagccaggagtgccaccaacccacaccagcagatctgtgtaccagaaacacaaaataacatgaagggccactggggggctggagcctggttccataaggatgggacttctgggcaggtgccgttagacagcagcaccttcttttggcctcatgttcctcagaaatgaaatgaaggaggtgggctcgatctcagactccatcagagcacagcagcctgggggtgtggaagcagagcctcacccaaggaccaaggggtctccaccaggtgagatggggaggatgggaaccccgtccctccctgccagggtgctgcaggtgagaacccccagggagccctctgcagagtccagggccggccagcagggcactcgcgtgggccctaggctgtattatttaatatttttaaggtggaccctgggcctgggctgatctaaattgtggaaaatgtcatctccctcttatgtaaaatttctccaaaggaagtgtttgtccacttgtaaggcatggtaaaaaaactagtacctatggcgttgcccagcacaaaacaggctgtctgggagtgtttgctgaggcttccgggaagcaaacacggaagggaagggaagggaaggggaggagaggggaagggaagggacgggagggaaggcggtgcaggctcctggagtcctcagtggtgagctctggagttgctctgttccctttttaatttttgtttactttttggctgttttttctttttctttttttcaatgtaaagtgtctctgtaaggcctgagaatgaatctgactggatcagcccagagaccaagtgagagcccccaaaactggggcttactttcttgttccgcccctctgggatattgggcagatctccatagcatccctgtccccatctgtaaagtgacaggattgaactcagtcctaaaatgtcctggcgtggttctaagacagaatccccagaacgctctttttcaaagcctgaaaggcttgggtcaggcaggcatcccggcaataccaacacctaccacgcgagggcgcgctgcccttccggcgcctgcagatgggattttttttttttttttttttttttttttttttttgaccacttgttctgaagctgggcactgggctaaggacaggagcagctggggtcaccgcaggggagagccagggggcccaggttaccaaagcttctggcctgaatctcttggcactgattacagtgcctcattcgtctctgccctgcacagggtaccattcacgccgggggtgcggaaatgaattaagttcagactgaatcagcagggatatttattgaggcattgtcaggcatctgctcttatttgggaacagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccacggtctgtggctctgactaagcctggactgcctctcggctgtgctccgtggactggctccccagggatccatgtgagagaccggagtatgatcctcagtgcgaggacaaataaaagtagtgattatgtccaccccatcctgccctccgtccagatctgttttcaacttgaggattcatctgccttgtccttgctaagacaccttcagcctgtggtcaggggaagctgggaagaggtgctgggagacccaggacatcgcaagttgcttctctggctggcactcagaggtgcgtgaaccctctgccaaccctaagaggggcaggagggtgcctggtgatgggccggagctccagccagccagcaggggcagaaggactaggcctggtccaatgggggcccaggatgtttttcttggcaaatcctcatacttttcacatagctctttcttctgagataagtgtgatcatctccactgtatctctaaggaatcagcttcctgagatgacacagtaaccaggaatgacagagctgttccctcctagtactcaaattggctcaaatttcaaccccactctgaagctttcctggccctctccccgcattcctgcctggcattatcaattgctctacgtctctgcccctcagacacttcggtgcatcctatcatagggtcttgtcactctgttgccatcatttatttacatatttatagtcctcccactagaccttgagctcctcaaggacagggcctggtacataaatactcatatttacatctttagtaaccactgaagaacaataaatatgaaatagaggaaggaatgagtgaattaacctaagcctcaaccactggtcttcttcagtgcaccactactgtcctttttaatccaagcactggggcagatttcaccaggggatgctgggaaaccccactgtgatcgcggccacatcctagtcacagcctgaagcccgcatccttgtcttatctctcacaatcccctggtttcaccgccttcttcctctcctcattccaaccactccccgtcccattggggtactcatctctacaatctggtcagaaggtggggcgaagcctttattagctctcctttattatagggcctcacaacagaacttgtaaccccttcattttcaggggcttaacacttaccccacgggaggcggcagagctaacagggaggctcgacgtgttggggctggagaagtgaaaagtcccctggcccctgagtctccacactgagcatctgcctctgacagcatgacatgtgcaccttctgtccctccctcatggaatcatagacagaaaagggacccaggatgtcactaaattgaagccatgccccaatgagcctcatggcatcctggaaaaagccctgaactaggaatgaaaatgcctgcgtccttgtcctatgtctgccgtccttgacctcactgagctttggcccttccttgataatttgaacacacgttgtttgctctttgattttgaaaacaaagattacatgaaattcctatgaaccatacagtattgggactgtacaggtgattcattttattaactaataattgaatcttcttgattcaaataagatacagcaaatgtgattcgagatagttgtcaacctggaaagaatacatattgcattttaacatcatacaggtggagtaatttagtgactaaaacacacacatgcagatacatgtataatttacacatagtgtctcactatgcaattatagccagaatggatttttttttttttttttagactgagtctcactccatcacccaggctggagtgcagtggtgcaatcttggctcaccgcaacctccgcctcccaggttcaagggatactcctgcctcaaccttcccaaatagctggaattacagatgtgcacacctgaacctggctagtttttatatttttagtagagacggggtttcaccatgttggccagctggtctcgaactcctgacctcaggtgatccaccctccttggcctcccaaagtgctgggattacaggcatcacccaccacgaccggcctagaatggatttttaaaccacccatgcatgagccaatctcccacacaagctcaaagtctaaaccttttagagttggtctgggctcttcagatcaaggcagtcaggtctgtcttgccacctcttggaacacttgaatgcaaataatcgtcacagaaaggtgaggctcttgtcctgccacccatctccgaaggtgatttattatcaccaaatcccacccccatgacaatccttgctgggcgatatgagcaggtccttcccactgaaactcctccaagcccctatccttcctcacatgaggcagagacgggcagcatagctctcccaggctgattatcaaccaactgaaaatggctgtctgttaacctactgcaacaataatgggataagatggatttttaacaaaacaaagaagaaaacctttcaaaatcctactcttgcagtaccataggctatgtgctttaacaataacactgcaatacctcagaatactaaaattcctcttttggaattgccttccacatacccctctatgcacacaaataatgtcatctgttcggaatgaattaagaaattcacccaaaattataaaagaaattcacccagggtcctcggcttcctccctcactctgcagagaagcaagggtccgccacactcagaagaccataaatggcatctctaaaatcctgatggtcctcgggatcgcaggatgccagaggttcaagctgtttccaggattcctccccatgggatgccacgggtgtgttagatcacctgcaggttgttctacaggtgactccactggaagcttagtcacaggtctcgcctgcagggaaacatgtgcctgtcctgactaaatctgagaatgcacacaaaggagtagcccaccctatagacaggctagcaagggcttcgtggtcactgtggttacccagagggaggcccctgggatgggacacaagcaccggcacagacaaggcccaggcagatgcagagctcagaccagatctgtccagcatacaggtatagaagaactctgttgctaaactcccaggggcccaagcacctcctgcaggtagacctagcaacaccacctctcccagctcgttggagcttactgaatgctttctccactccagcttctgtgccgagcaccgcccatgcattgatcccaggtcatctatggagtggcatgaatatgcctacactgtagatgagatacttaagactcagaaatgtgaactcacttacccagagccacacagccaggagccagcagacttttaccatgtctattttaaggttcaagaggcatgtctgcatgaagcaagttaatggtggaaactgatgggcccccaacctggtgcactttcccttatgccacatggttcctatgccgtagaatataggagacatgctgttcacccacaacgtcacttctagctctccctctcttaataaatagtgcttgtgacaatcactgtggtcataacaaggataacagaagaccatgcattaagaattgctttttatgttttacacttgatctgcaatgaagtggttattattacttggacatgaagaagtggaaactcacccaagttaagaaacttgcccaagagcacacagctggtaaagtggaagaaaggggcggagtctcctattctcactgtggtgggaatgtgtgaaaggagttggggtttctgccaaatgcatgtgttcctggatttgggcagggtggaaaatgacttgtgagctttgctccatgccgctctgggaagccatctcaaggtatttcacagctcacctcaagactaagagataagggacccctgccctgtctcaggagaaggaagcagacaggagcctggcaagatggtcctggaaggagggagatttgtgtctgtcccagcagtgggtattgggagaagccggtggatgattttacactcaaaagtctccatccctttgatccatgttagcatagcaggcttctcctcctgtcatttgaacttccaaggagaggtttgaatccactgttcatatttcccactcaaaaatataaatggaactagaggcacagttccatgcctctagacactggcttaagcctgttgtcaggccttgaattgccagcttctcgtgtcctgggactccaatgcagggctgcagggagagagaagggtcaggctcagacatgagacccatcactacaggaggctcccctggtccccgagtgggtctgcatggtgcagaaaagcaagagagacgcataaattcaatgtagcagagcgaactggcttccttcctatggtaggatcctgggtacagcatggaaactgaaaatgacaagtgggaaagactcgatgagcaagcacagggaggccagcagagagcaaagccaggtcccaggccctgggcatggattcagccaccggttttggtctaaaagcaagacggagacatccaaaccaaagccaggtggcccgtaaaggggcgatgggcaccagacaggaaggaggtcaagagcctccctgacgctgagcctggtgctcccaggcctccctaggtaccaggctgactgtcctgaagcctagtctgacccccgcattgactgcctaaaccccatcacaagctgctcactgtcctcctggttagccccaaacttcccaatagggtccccaagaccccttgtacagaagcccccgctaaactccccagccagaactgctgccttgttcatctccaaccagcccaaagtattttttcttgttgttgttttttgaaacagggactcactctgttgctcaggctggagtgcagtggcactgttaccgcttattgcagcctctacctcctgggctcaagtgctcctcccaccttagcctcccaaatacctgggaccaccggcatgcaccattgcacactgctagtttttttaggtgttgagccaccacttccagccccaaggtattttaaattcctgaactcacatgctttttattttccagttttgtaccctctggttcctacacctggggcattgctcacattttcccctgttcaccctttagcttgcagctctgactacactttctccgggaagctgacactcaggcccgaatgtggctggctgccgctcctgtgactcctccactgctgggcccacctggagctggagtctgtcaccatgcaactgcctcctgtgtctgctgtcctctacagactcctgtgccacccagagcctgtgacctgtgcaccatttattttcctgaatatttagctcgatgcctatgtttgtggaaagaaggaggaaaaggagggaggaatgaaactgggaggaaggaaggaagaaatgaaggaaggaagttaagaactagcccagtggctggcacccggaagagtgacagatcagccccaccagaatgtggggagagtcaaagggactctgtcctcccttcctgcctcccagttgactcagcgcctagatcctgggtgggggagcccatggagggaagcatcagctgccaggccgggtagaggggcagcaatggggggaccaggtgacaaagagactctcagcctctctgtaggattgaccaggcatgtggtagtgcctggaagtggggaaagttgctacagctgaagaagtcttggaaggcagcatttcggcatcattgtgcttctccatccttcttcctctaaaggggggtgtctttctatccaattcctcccacaagactcatgtgtcctcctccaggtgaggaaagcctggcagactctagcatgactgggagtaaaggtggctgggcaatctcagcaccaggaatgcacattcacaccacgagacagggcaaaggctaggtcccttcccggcagggggatgcgccagcctcgggcttcctggaattctcatctgcctgaccagctgatggcagagtcatggtgactcaggactgaatattcagctgcgatgttcgatgctaggtgtggtgcacgtcacaggtgagcaaaaccaaaggaactggaaaagcttcacatttgagtttaccattgacactgagttgttttacagggaggagcctgaggtgcagacggtatcagctacaggccaggttgtgtctctaagccagatgagtgtcctcatccttaaggagtcatcttcctctaatcctctggttctcatccccatctcagctgcttttgaaaattaaatattatgccaaggcacctcctgcagtgatgtgacttccttgtctggggtggatctttagctgttattattaagatacctcattgtgttcattctgcatccagagctcagaaccattgcttgaagtacagagttgtggttcttcctgaacaaagtgtttctgggtcctcctatgtgttgtgagcgttgcctggaaccgaggccctgctgggggtcatggtcttctgctgtggtcacctccatgtaaaagatgatgccctctctccaggagcacacaggagggttgcagtggaccacagtcaccctcccctgaccaaaagttccctcaaactcccttacacttttgtacgagacctatgcagtacaaacagaacattttatcaaagtttctggagatttcatcaaagaagggcaacaaattaaagtctggaaaattaatgcttttcccagattccaaaagggaagtttctttgcttaggtcctttaaaaggccagtgggctcttacgtgttccagcctcagtctcttgaccccaagttgtcctcctccttcattcaccctccttctctccttcactgcttgggagtgcagtcttgcttcaccgctctccttcactccctccctcccacctgccagcagtgaggacaccacttgattgttccagcacctctttcccttcgcttaaacaggctggagcagtcactgagaatagcagcaggaatatcatgggtatctagtgacacccaagctccagagaacattaagcctgaggggctgagttctctaaaatgccttgtctactgggtactggtcgaaccctcaggctgtctccatgcatgcccaccagggtgagtgcaaacaaacttatttcttagctcatgaacctgttagatagaacatctgtacaactccccaggacaaatgttaggttgtgaggacagtacagtctcaaccccaagtgaagaaagaaatatttccctgattactgagatgcttctcacttccccaagagctaggatctcattgttcaccaaagtagcatttgatttctttcctgctccacctcatgccttcttggatcattaaggtacactgtcaccctctttttgtatctcaggaggtgttgaacctggattcttcaagttaggatcaaattaaatattttttttcttcctggaaaaaaggaaaaaaaggtaagaagaagttggaaccttgaaaaaagaacaaatagattgcagggtagggaaagaaacagctacctcatttatttggctgagtagcctttatggaaataaaaatagagaaaaagacttccttttcaaagaagctgtccccaggaaatggagaaatgccaaaaaccacctctgtgcacatgcttgtatcagagaggaatagagaacaggagggtactgatttccactcctataatcttccgtctccaaaaactagataaagagatttcaatgtgtttttgagaaaaactaaaacacatttttggtttgccattgcacagaatggcatgaggaactcatagcatgacttaaagaagatgcccagttttgagattgaattaatgggcaactgctcaaagatgtgatattcttaaatatactctgagatctgaagttaacaaagagaaaaaaaatagtgcattgattttataagcaaaggaactacaaacactaaagaaaaacaattaacaacatgacaatagtaagtcattacctatcactttgaatgtaaatggattaaattttctaatcaaaacatgtaaagtggttgaatgtatcaaaaagcaaggtccaactatatgctgtctacaagagactcactttagctagaaggactcacacaggctgaaagtaaagggatgggaaaaatattccatggaagtggtaaccaaaaagagcaagagtggctgttcctacatcagataaaagagactttaagtcaaaagctgtaacaagagacaaataaagttattatataatgataaagtggtcaattcatcaagaaaataaaacaattataaatatataaagcaaagatttagagaactgaaaggagtaacagcaattcagtaatatcagagacttcaacaccccactttcaacattggataggtcatctagaaagaaacacaacaaagaaacagtggacttgaacaacactaaagaccaaatggacctgacagacatatactgaacattctattcaacagaagaatacacgttcttctcaagggcacgtagaatattttccagagtagataacatgtgaggccacaaaacaagttaataaatttaagaagattaacatcatatgaagtatgttttaccaaccacaatggtgtgaaactagaaatgtgtgtgtgtatgtagaagtgtgtgtctttttctgtaaagagggagggataagatgtattctagatgtgaggaagagagagaagaacataagagctctaatgttctaatgtaagaatatgtggctctgatctgggatttccctgaagtttgtgtgagcgggacttgtggatctagatgttatgacatcacagaacttcgcaaaggccatattgaaataaaaattggccagtgtcctggacccaagatacaagcagatggtaaaagaacataatttctctgttttagggaagatctcaaaataagcatcattcaagtggttctccaaagaccatcagagccaggccagtgagagatagtaaggaattgggtactgcagtgcattggagcactcatattctatgtaaggaagctgtccccaacctttttggcaccagggactagctttgtagaagacaatttttccatggaccaaggtgggggagatggttttggaatgattcaagtgcattacatttattgtgcactttatttctattattacattgtaacatacagtgaaataattatacaacttatcatagtgtagaatcagtgggagccctgagcttgttttcctgcaactaaagagctctatctgggggtgataggagagagtgacagatcatcaggcattagattcttataagaaacatgcaacctagatccctggcacgcacagttcacaatagggtttgcagtcctatgagaatctaatgctgccacttatcttacaggaggtggggctcaggtggtaatgcaagtgatgaggagcagctttaaatacagatgaagcttcgctcacttgcctgtcacccacctcatgctgtgtggcacggttcctaacagtccagggacgggtactggtccatggcccagaggttggggacctgtgatgtaacgggacaagagatttttggataaatctcagtgttacatgtagaaacgtgggccctggtggtttaatcattgaatttttctgaggaagtcagaaaactgaatttttatgcaaaatttttagtgttttaaatgttgacacctaatatcaaaatacttcgatggactatattttactcatgggcttccaattcaagactctggtttagatgcaggaatcagcttgacaattcaatgaaccatgaagacttagacctgtaatgacctcagaaatccatgattcctttcccttttgtaggcagaataaaaaatggaagggctagacttggtcaacagttagtctaaatttacatagcaaatttgtaaaaaaactgggactgaaacataggtctctaaatctcttccattctttgcactatacctcactatattagttatccattgctgcataacaaattatcccaaaacttagtggatgaagacgagaaacattgttatctcacacattctgtggattgtagaaactaggcatggcccagctgggtgcttctagatcaagctcagtcatgaagtcgcagttaagctgtcagccagggctgcatttgtatctgaagcctacacagggaaggatctacttccataaactcactcacatggttattggagggagttagttccctgtgggctggtatattaagagccttagtgactgactagctgttggccagagaagcccctcagttcattgccttgtaggtctctccatagggcgactcaaaacatggcagcaggcttccacaagagcaagaagagtgagaaggcatccaaaactgaacccacagcctttttatagcttactctcatgacttctgagattaggttataatctattgcttcatagacttataatctatttattagaaatgagtgaatgaggccagctcataatcaaaaggagtggcttacaccagagcatgaatcacagcatttcacaaagacaggaatccttggcagcaatcgtagaggctgcctgccacactcagtgtctcataaatttatgccaggggtcagaaaactatggactgctggctaaatccagttgccacccagttttataaataaatttttattggaacaaagccatggccatttgtttatgtattgtttatgactgcttctgtactatagctgcagaattaagtagttgcaacagaagccacatggccagcaatgcctagaaatatttactgtctagccctttacagaaaaggtttgctggcccctaatatatgcaatcataaaacctcttgaaaaatatggaagaggagattgagtcagagatgtcaaattcatcattttattgaatttttcttggtgctctagcaccataaataccatgctatgtaattttataaggcagttagctggaaattctcaaaacaggagtagccctgtggtctgagccaagtgggtgaggtgtggcttccattccccaagccctctctcatttattctccaccatatataatcatttacctttccactgggaaaccccacaccaaaaacctttgacagaaacatggatataaaatataactacaataacctgaataataaagcaagtagttagcataatctgtgagcctgatggtcctgggcttcaaattttagaaagttatttcgtttgtcttagccttagtttccttaatctttttttttttttttttttggaaacagagttttgctgtcacccaggctggagtgcaatggcgtgatctgggctcactgcaacctcaacctcccaggttcaagcaacttttctgcctcagcctcccaagtagctacgattacaggtgcccgccaccacttctagataatttttgtattttcaatagacactgggtttcaccatgttggccaggcttgtctcaaactcttgacctcaggagatccacccaccttgacctcccaaagtgctaggattacaggtgtgagccactgtgcctcctccttatccttaagtaaaaattctgatacctactttatgcctttttttgtcagagaaatgcattaaagcaccattgccatgccaggtacgtaataacagctccatagatactagccaccatgtgcaaatcatttaatagtcatccatggcctattaccacatcagtcaataggctcatttcaattaccagttctgaagaaaggatagtggcagacgacctgttttaacaaaaagtcccctgggtcacaccttttgccttggatgcatcacttccccacctcagctgccagcccattgatgagttgagctcatgattgctttgtaagagccacctgtcccctaaaagtcctccctgaggaagcagccatcagaactgtgtaggctggtggccagaggtagtatagggtgtgtttttactgggacagggccatgattaaatagaaagaacccggttggagttacccagtgtaaacagaaggtgaggtagtattatgcacttcattctatttgtggtgaaaatattgctgccaaatgggtagaaaaatgtctttagggtagctttatatgaatttctcatacacttatcccctccttgattttgcctataggaattaggagagtcagtccccatcttgtcaggcatgattttagaaactctgggaaaggcatgcaaccccacatcactgctaagcctgtaaattcctaaactagtttgagcctgttttaaaaagatgccatatgttaagcctggctctctctccatagcatgtctccctcagtgcctgctggcatcaccactttaattctaattgatgggaccgccacctaccctgtcccctgaacagtatccctaggctgcctcctctcttaattgcttctctcatgctcaaccattgtattaactcttgattgcttcttctagatggctctggcactcaggtctgcctctttctcccactggcatccgaaacacagcagacctgagttcagctcttggtcttctggccttcagtctcataagcctctgctccaccctccatatcatatctgcaccaaagcacgataccagcattccctaaaggcaagggttactgggggccattgcagtggctgcctgccacactcagtatctcacgaatttatttatgttttgttaaaccataagtgtgttcagattgttctcatgttgtaaatcatttgttgtctttgcattagctgctactgttctctccctatttccttgctcttctggaagtatttcttctttgtgatattcatcctgagcatcctaggagatactctaggatttgaaaataattcttattatctaaagggtgaaagcaacataggacttgagtatatactttctcattaatataaggacataaatgaaaagacaccatctattaaagataataagaaatgttcacaaatagtatatggcattcattatggaacttggtagaagctccaagtgtcatgcaaaatgtgctctgcagaactgcagaggagggagggatctctttcaactggggtgattgagatcatgaggaactggtatttgagttggtccctgaaaattatgcaaaccactttgtagaaagaattggctgatggctgtaaacccagcactttgggagcgcgaggagggcaggtccctggagatcaggagttcaagaccagcctggccaaagtggtgaaaccctgtctctactaaaaatacaaaaattagctgggcatggtggtgcaaacttatagtctcagctatttgggaggctgaggtgggaaaatcgcttgaacccgggaggtgaaagttgcagtgacccaagattgtgccacttcactccagcctgggagacagggtgagattctgtccccccctccaaaaaaagaaagaagagtcagaaagaacctagtttccagcatctatcaccaagcaatttggagagtgaagttgatatttacagaaaaagtgatgtaaagattggttgagaacattggggaaatggtccagactagagatgaagatggaaggtagctgcatgcaggcatagataaccacatcccaaagatcatatgaagccagcagaggcccgcgagtaagcatctggaatacagttaggaacatgggagcatcaactggcctttccccatttgggaaatgcagataagtgtatcaacattattaaattactgcatgattcaaatgaaataaatgcaagtaaattgcttagcacagtgtctagaacataatatgtgctcaatagatctgttacaatgacgtgacaatgatgataaggaggaggatcattatcatcatcatcattatgattgccatgaaaatgttaaattcttgaagatgttcccttttggggacttcagggacaggagaaggaggaaaacttccatgatgaatcaaaggcagtaatgggaaggataggaggagacaatggaaagcggatgtctgttatatcgtgttactgtcagcttgtatctttttccattagactaggaaatagtgaaaattcagagcctagagagtaaatattgtttatctttctttcctgcacagcaccaggtcctaagaccctaatacagagcagatgtccatgaagttctctggacgttgaattgaaattgagggataggtttctgaaagtggccttacgaggcacatgttgcaaaacgggcaggttggaagattacagacaaaaaactcattgagctggggatgtaaaaggcttggctggacttaggaagagtagtttggacagatttcttgagatgctaggatgcaaagaatttagggacaatggggtgatggaaaagggtacacacctaagtatagaccactacacatgagtgtagatcaccaatagtcaagggatgactctgagagcaggcagagaaatgactggacatgctggcttcaggtcacaatgctgcaattcactacagcatgtcattcaacctctctgagcctcagtgtcttcatctataaaattggaaaaatgtctgcctttatttgtataacttatataatggtggttgtgacaagattaatggctgcaaaggagaatggctgagccaaccttcatcttagactatgtcaagatgaagaggagttgacaccctggattcccgtgctgggagcccatgccagagtcttgatattgttaaccgagggtcacgtgggtgatacttgggtgatacatgggtcacatggtaatttgcaatgtacaagtcaatttcacaccattaactcatagggctttcactgtgacctaaacaggaaatgtactgctctctgtgctttgttgctgagttacagatgctcacagagcttaggtaatttattcaggtaaacccacgccatacacggtagggctgagtgatggcccaatgacgcctcacttcagacctggtgtttgtcttctacatagctctgcccttctgccacaaacttggaccaatcacatctcagctccacattttaagaacaggatttaaaaaataataattaaaggaaagtctgacatgaacaaaggtgataaataactaaagtttctcttccttgctcaacctaatcaaaatgtcaaaatgctggctgtgagagctacaaggaaaccaagcacatgggtacaaaaatttgcaggatctgcagttccaagtgctgtgactcagagcccaggggcagggagtgacaagacccagctgtcgttagtgttgtgtggcttcagacacatgaatctattcacccaactattagacagcacacgtgtacttgttatcatttgagaggctaaaagtatttatgacataaaaaggattataataagccaaaaagaggacaattcacagttgtcagtggctccctggagtagagaagtaaattacacagtctctctcttctattgtttgaaattttaccataaaaatgcattacttttataattttcttaaaacaggtaagtccccctcaaaacggattttgtgtgtctggagtatgtccaaacttgaaaaggctgattgtcacagcccaatctccaattcccagctcccaaactagttgacaagaaaaagtggcatttttcctcaccaaggaacttttatgaaatagtggtgttgccataaaaatgcctcccagtctatgaaggaacaggttagaccaggggttcacctgtggaagtctattctccatgtggaaaagcaagtcatctccagcgtctgactgtcctcaccccaggctgagagctggtgctaaccctctacaacgcccaatgccatcgttatgtctgacatagtaagactgtgaagtcagcacccatcccacccacactcacctccttcccccatttataaatatctccaattgctttgtctcaaatcatgaactaaagaggaaagttagattttaaaaagtagcatctacctatctaaagtcttaaatctgctgattgagctccactcttggctcaaagagttatctttgagttatgatgagttatctttcttctacgtttctgcagccctgtgcttgaaatcttcctatgactcccattagaattcatcctaaatttatcatttgactgtctgcccatctacctggccctacatggagcttctggagagaaagaaccaagactggtccctcttggtatctcatccacttcaccctcacctatgctgaagacatgatacttgtcccttcctatagtatgtgttcagagttttcttactgaatctgacaggtgtggtgcacccaaattctgaacacacactcccagaactaacacacccttgatccttagtggatccgttataattgcattcacacgaagcagcagctaggagacatcacggtgacttcagctcccaattgaattgtcattgacttacttagttcccaattgatagtcaaccaaatacaacccatccattggattcctgaacatttaagtttaatagctgttttttttttcttttttagcatttttccctctaaacgttgaatctatatgcaggggaaatcatctggcccctggactgccttgaatgctcctgagccaagagtaacttgaggtcttaaatgtctattctgaagcccctcttttgcacagggacagtcattgactaggaggagatgccagtctattaaatctatcatcccagcatcctctttctctgatgaagtaaaattaaacaccttctttactcataaatttggtaggttttagacaatgatgaagaatcggacatgggccgcacacagtggctcataccagtaatcccagcaatttaggaggctgaagcaggaggattgcttgagcccaggagttcacatctgggctcgaaaccagtctgggcagcatagtgagaccccattttattttctacagaaaatttaaaatttagccatgtgtggaggcatgcgtttgtggtcccagctactcagggggctgaagtgggaggacctcttgagcctgacagctcaagctgttgtgagctgtaatcatgccactgcactccagcctgcacaaaaaagtgagactctgtctctcaaaaaaaaaaaaaaaaaatgaaagaatgagacatgtttcactcaaattatagcaccccatcataggccaagggccaggtggtcagctaaccttgaatgtagcccattttcctcccttacctcactaccaaaaagccagtcctattgccagatattgaatatgtccagggctggatttatttggtccccaggagggtcttagactctcccagcattttaggaagagaaaaaaagctccaaagcagcaaagtacggacaagtcagcccccagccacatgccctgagactattccccaaagggggcatacttgctcatgccagccctatctgtacccacaacccaatctgacccacacccagacaagcccctggagtccagagagcacccggacagccacaaatccatagggagctctgccttaccattgggttcctaattaactgagtgagtgggtgtgttctgcatggtgagaggcattggaatgatgcatcagaaaacatgtcataatgtcatcactgtaatatgacaagaattgcagctgtggctggaacctttataaagtgaccaagcacaccttttcatccagtctcagcgtggggtgaagcctagcagctatgaggatccattatcttctgtttgctttgctcttcctgtttttggtgcctgttccaggtaagatgggctgggaaatctaaggattgatctaattgagaatatataattcagagtcagtatttctccatccttcagagtgctttggaccaagcaggtttgttgtatgggaactaggcatcaccacttttttttcagacaagaatcattaagaggccaggtgcggtggctcatgcctgtaatctcaacactttgggaggccgaggtgggcggatcacgaggtcaggagttcaagaccagcctggccaagatggtgaaaccccatctctactaaaaatacaaaaattatctgggcacagtggcgggcacctgtaatcccagctactcgggaggctgaggcagagaattgcttaaacctggcaggcggaggttgcagtaagccgagatcacgccactgtcctccagactgggtgacagggtgagagtacacctcaaaaaaaaaaaaaaagaaaagaatcattaagaaactaaatagctccccaaagctatctctttccccaactcttcaagggaagattattataccagctgatgagacatgaatcagacataaaagtttaatgtagcaggaaagattgatttactctgagaatagaagcacaggctcctgttctactaagtgcaatggttggaggtggagtgttggggctacctctgaggacaccacagcctcagcacccccactgttcctgcggcagtcacagggtcacgccacttccccggtgccactgtgggtccacagctgagctgcagccttagaaacattgtctatgggttgtgtagtcataccttcatcttcctcctgattttatagaaaaaggaaaaagaaacaaaagaatacaagaaaagcaagggatgagttatttgaggaattccacaagccttgtacgtgtaccaaaagccttcctaaaacctttccgtgtgtgctgttttgtcattgcaggtcatggaggaatcataaacacattacagaaatattattgcagagtcagaggcggccggtgtgctgtgctcagctgccttccaaaggaggaacagatcggcaagtgctcgacgcgtggccgaaaatgctgccgaagaaagaaataaaaaccctgaaacatgacgagagtgttgtaaagtgtggaaatgccttcttaaagtttataaaagtaaaatcaaattacatttttttttcaaaaaaaattaggagcttgatttttttttttaaatctgattattttggtacttgtttccaaacagacaactcagaaaatcttaaggactcacctttcgttcaaagaaagtagaatctctggagaaatctataagggagcccaaccttattatccaagggttatcaggttctattcctactttgtgaacgttatgccccagtgaagttggactcttcactctcttggaatatgccctttgctttcatgtcatccaagccttgggccttttcagtccctctaccccaaatggcatctgtccaccaaatctatctctaaggttttcatgcatccctcaggggctatcccaattccttccaaaaactttgtcttcagagaaataaggaaactggctcttcctcagatattcactttgctttctctcacccatgcctctgctctggttgacctcatgtctgcctcactcctccaacttcatctctaaactttaacctgtccttcagggaccgtctcacattttatctccaccttaaaaacacaggtgatttcccaaatgcttacagtctttcctctggttcaccacagggttctgacttgagtcctccatctacaacccttgcttggtttttacattgcgtacagtgacatattgccaatctccatattagactttgtgagccttaaaagcaaggagtttgtcttaattcttcctgtactgcttgtaaagtgccctgagcatgaaggctgctcaacaagtatttatgaattgaagtacattcaaacgatttattgattgaattatctttaatcattcaaatgatttggaggtactgcagtttaactatctagtgctctctcaacgttgatgcagtaggattccagcaaatggagtgtgtggtttttcatacctgacaccagaccccagtcatggctccacgtatggagaaaagacaatacaacaaggctcttaggaagaaaggctcaagggctcaaaaagatgagactgctcctcactttccatccaaaatggactcactgctatgggaatctccctctgacagcagacaaaagggaacctgtcaagatgtgtgacagctgtgttcagacattggataataagcagtgcaacagaccaatgaagtgagactttcgattgcccccagctcactacagcagcagggtccagaccacagcacacagaggaagactcaaacgaagtccagcaatcctgaagcattgaagagactgaaatcaaacttcccaaagcacaagacacccccacttccagggcagaatagcagagagaggttgcctagaaggaagcaaggccccgaagtgttggtggtgggggcagggacacatggtaaatcttcagtcctgggctgtgttttcatgtgagcacgcttggggtaagacttcacaaggctagaggcaaagaaaaacacccaaaagggattggataacaattttaggagcactaaaggctggaaaaattttcattcccactagcaaagtggagagactgcagagtccttgggcaactaacacattagtagtagtgctatttggctctagattaaattgttctgcaaccactctaacaaatttttttctaaaccattcttgaaaggaccagactgatctatgagaaacttaaatgtgggacagaataaagcctaacgttcttcaaagaaaaacaactaaatccatcactcaacagtttgtgctttatagcacactgaatctaataaaaaattagctgctatgcaggaaaatatggtcataatcaagagaaaaatcattcagtaaaaacagatccagaaatgacaaggatactaggatcagcaaaaaaagatttaaatgagctattataaatgttataaatatgtccgagtttgaagagaaaaactgttcatgatgagtgagagatataaagagacaaatggaatttccagagattaaaaataaacatctgagtaaaagatactatgagttggattgtggcatatattccaaaataaagatcagtaaacctgagtttatattactacaaatgaatgaagaaatagtacaaagagaggagaaaagggctggaaaataataagcagtgacctgtgcagaaacatcaagcaatctagcaactatgtgtgtttagacagccaggcgtggtggctcacacctgtaatcccaacactttgagaggctgaggagggtggatcacaaggtcaggagttcaagaccagcctggccaatatggtgaaaccccatctctactaaaaatacaaaaattagctgggtgtggtggcgtgcacctgtaatcccagctactctggaggctgaggcaggagaatcgcttaaacctgggaggcagaggttgcaagtaagccgagatcacgccactgcactccagcctgggcgacagagcaagactccatctcgaataaaagaagaaaagttttgagagagaggatagagctaaggaaggaatggcctattgttttccaaatttggtgagactataaacacacaaatttaccacatgaagacatccaagttgaaatatgaaacatgaagaaaaccacatgaaacatatcataatcaaattattttaaatcagtaataaaaagaaaattttaaaagcagcctgagggcgggcacagcggctcatgcctgtaatcccagcactttgggaggccaaggtgagcggatcacctgaggtcagcagtttgagaccagcctggccaacatggtaaaaccctgtctctactaaaaaaaaaatacaaaaattagccaggcatggtggcacgcacctataatcctaggttactcaagaagctgaggcaggagaatctcttgaacccaggaggcggagatggcagtgagccgagatcaccctactgcactccagcctgagcaacagagagagactgcgtctcaaaaacaaaaataaaactaaaaagcagtctgaaaggagacatattacttacagaagaacaaaacgttaagtgttatcttcaaatgccgaaagaaaaaaaatgttctcttagaaatccaccccagcaaaagtatatttctaaaaaaagggtaaacacataatcaaataataagtaaaggcattttccagtaacaacaataaaagctaagagaattcctcaccagccagtctgtactataaaatgcaaagataagttttttggcagaaagggaagatgctaggtagaaatttgattccatatgatgaaaagagcatgctgtgaacattctagaagctccttaaagagagagattgtcagttcagtaaaaagcaagacccaactacatactgtctataaaaacccactttatatataaactttaagaacaaacttagagtaaaaataaaaggatggaaagagatataatatgaaaacattagtataaagaaaataggattggctatactggctcattgacataaattagggtagattttagagcaaggggtattatcagtaatagggagagatatttttcctaatgataaagtggttacatcaccaagaacagatattaatattaaatcagtgtgtgcccctaataacagaattttgaaattcttaaagaaaaatcaatagacattaaagaaatagacaaattagcaattgcaattagacaattcaacacttctcttcctgtaagagattttttaaagcagacaaaatattagtaaaggtagagaagtcttgagcaacgctaccgtccagcacaacctatttgagatttatagaacactctaccaaataacagcagaatgcattaaaatattacccaatagagctcatactaacctatgaaacgtctcaaaaaatcaacatagtttaaagttatacaaaagacagtgtctatctacagtggaatttacaaaactatcaatacagagagtcatctggaaaaatctccatatattgggacatcaatgaacatgtatctaaatggtccagaggagaaatcacaagatactttagaaaatatgttcaactgatagaaaatgaaaccataacatatcaaaatttgtggaagtgccactaaagtggctcttggagacaaatttataattaaatgctattatgatagaaagcagaaaagctcacaaatagacaatttaagtttccactgtaagaaacggtaagggaaaagggaacaaactaaacccaaagtaaataagaaaaagaaaaaaaaagagaaaaagaaaaagtgaataaaaagaaactggacacaaaaaacattaaaaattagtaaataaaagctgattccttgagaggatccatacaattgtgagaactctcaataggttcattaaggggtaaagaaattactgtaagtctcaggtgcacacccaggcttcaggcaggcaggaaacagattacatctgcgttttagggtcatatagacgagccgccacgaggtggcagtaactgcgcgctcattccctcacctcctgcaagaccaggccagcccaggctctggactcaccactcagctcagaagatggaagagggtgacagtagctccatggactttggctttaggcagagcgttactgtagctttggggttgtaggaggatgaagaggggaggttatcaggacaccatgatgattgtgtggcgctggttaggaacatgggctttgaagagagggggattttatttcaaattgcatctttgccacttagtagccaggtgaccttgaacgtgtcctccaacatttccatgccccaggacctgcctctgtaagcttgcgtaatacctacctggcaggcttgtttctgaggatttaataagataattaatataaaaatggccatagcagggctagccgcaaaattcctaagtttcagtgcgaaatggaaatgcagggtaccatggtttaaagagcagaaaaagaaagtgtaatgaaaggcagtaggatattaagctttttcaaacaaatatttttcattgtttgaaaaatgtaatagttatacaggagtaatgacagaatcttacaaatctccaccagaaattaatttcatagttttaatagaataaaaatactactctattaattggatttagatgaatcatacaatttttctggcccacttttctgtcaaataatatattaggacaacaaactttataccttgagcaacttcattttatcttttgggaagaatctgctgaagcaactgtttctggaatatattccaagctgtgacaacatgaggataaattattttgaaacagattttagtatatctggagctggtgattcttgtgaaacaatttgactcaaaagatttaactctttaaacaaatcagtttcatgtaaatttgaatctaattttaagtgtcaatttctccagcggaattttgatgcatcttctgacatgttctgtaagttgcagaggcccacagcagaccaatatggcatcatgatttgtaacttattcaaaacccctgtttatgaattctattgctatgtatttattaacaagaaaaacttaatttttaaaattgccctccttgttcataattgattaatcagaaggtttttgtttgtttgttttttgttttttgacaaggtctgtatttttcaggctggagtgcagtgctacgatcattgctcactacagcctcaaactcctggactcatgtaatcctcatacctcagcctcccaagaagctaaggctacgatcatgtgacactatggccagctaatctttattatctttattatcattatttgtagagatggtgtctagttatactgccctagctagtatccaacacctggcctcaaggaatcctctgacctgaacctcacaacgtgctgggataacaggcgtgaaccaccatgcctggcccatcagaagttttatacaaatatagcatccttctctgttgaatgtgactactattacatgtttaatttccatttctgagccttggataatgccttaaagaattctaaactctctgaagaattccaagaacttcctggtatactttattgcaatgtccatgggcacacttttgttttgtgcttctctcctcccagtttgctatctgagcacctatggttcctgtcctggtgctcaggtcagggggtaaatctttgtgcagaagctccaaggatgactctgagaatgcacaggcacagagctgtcagtgctgcctccacacagagaccctccattcaccccagggctgaggacacctgctgctgctgctgctgctgccacctcccatcccagtccagatgtgcctgggctgctccaagaatgcctatgctcagggcagcaaagctctagaacgtccctgggcctgagcctgcccaccttgtctcccctcatagccactctgcccatgtgcctgctccattgtcctcagtaagcttcacttaaaaaacacaagttcaaagaaaaaactaagaaagtcagggagctatcagcagagcctgacaccaggtaccggcccttctcagagcagattcctgtgtcactgccctgccttcaagcccatgaagctggctctgcctccagaattgagaaccagtaaaactgcttctgttacttaacattgaggacataatgcagagaaactttgttttctaaatcatagagatgagagagtttgctttctgggagcctatctataagaatgaggcttcccactcttgcctggggaactgaaccattttgccacaaagaaacagcctgaaattctctccccagttatagagagaggtttggggacacagcacaggtcatgtttcattaaaagacagcatagtgagtctatttgtcagttagacttgatggttcccattttacacacaacctggctttgcttttagctcattaagaaaaagaaaagtcatgtatattttaccaaatcttgacatgtccccaaatcctagaattgctgcatctctggttttagtgaagagccccatggttctgccagtggatggtcttccttgctgaagcaagatcataaccctacctttaaagcaaagatgcccctctattggtccttatcaaacacacttcatcactaggatgaacacagctgtgaaggagtcacactgggctgtgccaggagaaaagaagcagctgcaaccgtaggaatcttcatgggaacagtcagcccagctgtccttgagcaaccaggcacatattccctaagccttggtggcttcttccccagggacacaggtgctgcatttcacagtgactttcctatttcagagtaatttcacctccttctctaacaaggcctcacaaatgtactgagagctagagaggacaacaagtgaaaaaccacagtgctatcggtggttcctgggattggaacaggtgtgtaggaaaaattcactctcttttatgggtgagtttttaaatgtgagtgtattacttttataataataatgttaagcatagtagtcattaagaatgtatcgatcaggaatgaagtctcacatgaaaaagatggcaaccagtcccttaattcaaactctaagccccaataaggttcttctcatagtaccatgacatttccttaagaatatttactcaacaaattaagagacatgacaacctgatttgatgtgcaaatctagattaaacatgtatccagaaacatcaacagccatgaagccatggttggaacaattggagaaatgtgaaatattgacaagataataaataacattgaggaactagttttcttaatgtgtgtaaattgtattgtgtttgatgtgggaatgtcccctcatatgtaagagattctgctgagataattacagtgaagtgtcatgatgtttgcgtctttcttttttaactttaaacaaatttttagtacacaaaggttgtcacataattggaagtttctctactttgtacacaattattctcactctgcacagaaaggctgcttaacttctcatttggtggttgcaagcactaaaatcctgattttaacagaatagactactattcatttttactaaaaaatgcctcagtgatttaagttgaaaacagtacatcagtacatggctcttgtacccagtgtcaggaatgtacaagatctttctattcaaaaatacaaactaaattatctgtaggcatggatgacagctgtaaaccattatatattttgtcagttgaaaccagtaactgatggttatagtggtttcttaaacatcagccagccttttcttcattttctccaactgacttctctgaagttattggtgaggaacactgccttgggcttcctatcacaattcattaataaaggtaaagcactattctaggaattagaacaggccacctcccattccacacattgcacccattccagggctgttcccttctttaggaatttttgtgactacaacagctgctgtagttaatagagaggccatgccagcagcatccaataaagcagttctcacaacctttgttgggtcaataatgtctttttccaccatattcacgacatctcctaacatagtatcataaccaacttctgaggaactttgcataattttctcaactatcaaaaatccatcaacacctgcattcttagcaatagtcattgctggaattttgagtgttcttttaataatttctatgccaattattttatcttcattagctggagtgaatgagtccaaggctggaatgcatcgaagcagggcacaaccccctccctaaacaatgccttcttcaacagcagctcttgtagcattaagtgcacctataactctgtctttctcttcattcacttcaacatcacttgtcccaccaaccttcagcacagctactccatctgaaagtttctccattcagtttttccttttcgtattcactagttgtgacatctgactggtcaatgatttcttgaacacatttttcaatttgagacttgttaccttttccttttaagagcatggcatcatctttgatcacagtgacctctccaacttctcctacatcacgaggctgaacgtcttcaagatttagtgtcagccctcttctccaaacactgtaccaccagtagcaataaccgtatctttaagctggttctttctattgtcaccaaaccctggagctttgactgccacaacctgaagaccaacctttagcctattcaggatgagtgtagttagagcttctccatcaatgtcttcagcaattatgaccaaaggcttacagtaagcattggcaatttcaagagcaggtacaatggactggacactagaaattttcttttcatgcaacagaacataggcatcctggaattcacatttctcaccttttgatgtattaagaaagtatggagaaatatatcctctatcaaattttcatgccttcaataatttctaattcatcagtcagtgtttttccatcctttactgtgatgatgccctttcttccaaactttttcattgcatcagagatgatgttaccaatttctttgtctccatttgcagaaattgtagcaacctgtgcaatttcttcaggtttggtcacaggtttagactgctttttaagttcagcaattacagcatcaacagctaacatcacacctctcttgatttccactggattagcacctttgctaaccttctggaaggcttatttggaaatagagcataccagtacagcagcagtgatagtgccatcccccagtctctccatttgtgttattggcaacatcttggacaagtttagctccaatgcttttatatttatcctttaagtcaattgactttgcatcagtcacaccatcttttgttactttgggacttccccagctatgttcaataattactgttcttccctttggccccattgtaatggctacagcatcgacaaaaagtctacactttgaagcattaaggctcagacatcagcaccaaattttacatctttaccatcacttcaagtgaggtgaggagccagtagcctggacactggtctcatctggtgaaagactgtgggtaatggaagcatttctgtggggtggtggcaggacatgtgcatggtgaggcaggtcatcagcagcaagtgagagctgcctcttactttctaaaggtgacatagcaagtatacaaaaaaaaaataaaatattaatttaggcagagcacataaaggctttatttcatattccatttctctgtatgctttcttcaccaggaagaaatagttttagtgtcaggaatgaatgagtctgcccctcaattccagcctgctcagcacacaaggaaacaaagccctgacaatcagagtgactccctggtgactaagctccagtcctggatgcatatttgtttagcagttctgacagcatctgacccagccctctctttgcataccccaccagaaccttctttttttttttttttctttgagactgagtcttgctctgtcggaagcgattcccgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaagtgctgggatgacaggtgtaagccaccatgctaggctcagaaatttccttttataaaaatgtcattaaggatcttggctgcacaatatcgttaccagcttcctttaaatccacctctggcctgccaggaatcagggttcttcagaacctgacattttaaatgaagaggtcaggcaggtcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaagaaggacagggtcctgagagacaccagagacctcacacagccctgaaaacatggggctccttcataagtgtttcccatcaccaacagggagaccacgtggaggccttgcagccctactcggtgcttctccaccaaatcccaagggcagtgacgctgacgtctgtggaaagcagagaaagccctggctcccaaagccctgaagtcctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctccagggtccctgggtttgagccagccctgtatcatccccaggagctgaatgtccgagcaatggatagaattagatggaaagagctctcaatttggcctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggaggaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctctttttttctgtctttctttttcctctctccctagagcatgtctttctttctttctctttcctttcttctacccacacttttagactgagtagactgaatgccctatttaattgaaccaagcattgcttccttcaatagaaaaggagtttgagaacccaatggacaactcactcgttcttctaagccaatatgaaggagcccagtagtttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagagtagatactgcaacctagagaattccagataatcttaaggcccagcctatactgtgagaactactgcagcagacactctgcccccaggacttttctgatcagaggccctgagaacagtccctgccactaggccactgcaggttcacaggacagggacagcccattgaaaccaacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatattttccaaaacctagaacagtataatgaaggaaggcggggaggcagggaggcagggaggcaggctggtgggagggggagggagggagggagggaaggagggaaggagggagggagggagggaaggagggaaggagggagggagggagggaaacaaaaagaagaatgaggttgaaaccaggacttagatattagaaacaagccattacaaaatttatttctatggttaattgtggttttcaactgtaagttacttggtgttaatttcctattaaacaatttcagtaagttgcatcttttttatcccatctcagatcaaatacttaacagactaaatgatttgaaaaagcaaaagtttactggcttgtgtgtgttaaaatggaggtatggtggctttgatattatcttcttgtggtggagctgaattcacaagagatcgttgctgagctcctgccagaccccacctggaggccccagtcactcaggagagatcagggtctttcacaatcaggttctacaaaaataaacatcccccaaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattggatgatgttggtttgggcaggccatctctaatatccttgaaacacctttttctgctctccaggaaggggtcagggctgccacagcggggcttggagtgctttccagggtcacaggcatctgtattctttggattccttgaccttccccatttattcccggcattttcctaaaacgtgtgctttgctcctcctgcatcctccccttgcatgccctcacctatcccacatcttccctaaaaaaagcaagcccaactcaaagaccagttccctcatggaatcatagtggatctgccaagggaggggatgcccagtcctctgttcttcacaaggactcccttcttctggctaaggtttcttatgcaattatgcctcctacagaggtgcgtgaatttttaattctccatttagctatgagatttctactagtgtggactttgtcttattcatttatgtgctggccattcataaactatttcattaattggatggcaaaatgcagttgtacaagggtttccttacatacaaacataataggatccaagtaaatgctgttaaaaacaagtctctttgagggcacaattaaatgaggacaatatggcatgggacacaagcagaggggagcaaacctcaagaagaaagactcatcgactctaagggggagcatcaagatagctccctggccctgctctctctccttgggagggtttggtccttaaatcatgaactctgtgggtgtatcctagacgcataagaagctctctatttcttcacattagctctgcactgaatgtgcatatcatctacgtctgggaaaatgcaccttagttccaaaataatccattgtctttcctaatctcaagattgaaaaaagtaaccagaccttgttagagtaaaagcatttttatctggatatagattttatccagacgtgatgacagagccaggactagggcgaagcgagggaggctctggcctcaggtataaaatgtaagcactaagatatcctgtacttaagatagatgatcttataatgcgatagatttttaaaaaataatattcatgaaaaaatcaccataattaacaaactctccaaaatttaaaccaagacagggtctaatcctgtgattgtccaactcagtcgcactcacctaccttgatgccaggatagtcagaccctgcctttatttagtcatttaatattcatcgtatatacgttgttattttgaataaattagtggatttcttgattcctggaagcatatatcatttgactgtataaaagaagtgaagcttcacacacacaaaaaaagtaaaagtcaccatgacaatgacattcattcctatgttctaggggaaacagcacaactctcttaggaagaaactctccttttatttaagaagaccctttaatggctgtttaggtcttggaagataggacacctgactgcatctgtgaaatagagatacaatccataagcgctaaatcattctacaattctaaaaataaaatgttaaaggtttcttggccctcagagattaacaatgaaaggagttctgggttccaaaaggagcaggtatacctgtaacatcagggcacaaagtagcctgtagaggttattgccaagagtggctgaactctttagctagaatgcactctgatttctattcttatttttaacagttctgtgcattaaccacccgtcattatccttatgtttttgcaaaactgtgtctcaatcaattgctgtgtatttgaaaattcttggaaaagggggaaagcctcagtaattcttaatgcaaagctacaaagaaaatgggtagttggttgcaggagtgaggtggaggtggccagagaatgtcacacagaagacagaaataagaatttgcacaagatattaggagcataagcacctgtagggagttctgagaaacatttggctgtctacactaatgaggaatgggagctggagctgtttaatttggatggtcaaaaataggataactccgggagtttacagaattcacagaatccattccaaccaagtgagcttgcaagtcatactctaagtctctgaacctgtgaactcatgacataacagaataaaattgttcccatttcatcgtgcctgaagactcataagaaaaaaaaaaaggtattaattttaaacactgaagctcattcatcattttattgaattcacctggctacaaaattagcaactgatcttgttccaactatatttaaagcagatgaagaaactctccaaagaacagggtttgtctgagactagtctaggtagagtttacttttgacacatcctcttggtgttttcagagctttttgaatatgtggaataatatcattgctttgagcagattttcagccattagttcttcagttattgctgctgtccctcgctcatttctcttcctggaaatagaattgtctagatagatagagaattggtccaaaagtaattgcggtttttgcctttaaaggtaatggcaaaaactgcaattacttttgcaccaaccatacgtatgtacacaaacacatatgcaatatgtgtgtattgcatatatactcaatgcaaacacacagatacacatatacaaagcatccttttactgtgtcttcacatatatatttatgcaattttttgtatttttcattattttatatctctgcacttcaacctgaaaattttccactgacttgtattcttactttttttttttttttttgaaacagagccttgctctgtcacccaggctggagtacagtggtgtgatctcgactcaactgcaacctctgcttcccaggttcaagcaattctcctgcctcagccttctgagtagctgagattacaggtgccctctaccacattcagttaaattttttttttttttttttttgtatttttggtagagatagaatatcaccatgttggccagcctggtcttgaactcctggtctcaagtgattcgcctgccttggcctctcaaagtgttgggattacaggcatgagccaccgtgcccagcccactgacctgtgttttaattcttggatcctctactctgctctggtcactttgctattaatcccatctattgtgatattgacttaacatattgtatcaagtactagaattcaattatttaatatttttacataagacaggagagtctattcaaaaatgaaaagggtcagacatgtttcagatgccccagccttcttgggatatgggctttttcatgctaacatctgtctcttaatgaatccaaaatgaaggagtgtttgcttttaaaagaatacatttcagtgaaggtcttgatcaaagagagataattaaaaaaacactaaagaaacatcaaaaagatctaattgtagggtatctgggggatgataacacatccaggaaactttttctcagagacctgtgatagaaccttaaatgtacttttctttgttttgctctcatatgtgagcaacttagaagaaacatgtatttagaagaaacatgtatttgtttgtattaatcctacatgactagggttgacagatttagcaaataaaagtataggacactcagttaaatgtgagttttagataaacaacatccagtttattgtggcattatctatctcatactatttgggattaaatacactaaaaagttcttcatggtttttctgaaagccaaattgaacttggcctcctatattcatctaataacactatgaatcactgaaaacattttttctttaaagatatttttcttggtgaaagtatttattacgtcactgaattttattttactaggtgtagtaggtgtaataacggcatcccaaagatgtccatgtccttatccctagaacctgggattatgttacactttacggcaaataagaactaagacagcagatagaatagttggctaatatgctgactttaaaaccgggagattaacttagatcatgtgaatgagaccaacgtaatccaagaatccttaaatgtggaaaagaaaggcagaacagtcagtgtctgggtgatgcgatgtgggaacgactcaacagccattgctggatttgaagatgaaggaaggatccacaaaccaaggaacatgggcagcctctcagatttgaaaaggcaaagaagaaaaaaaaaaaaaaaaggaaagcaaactcagcttcttagaacctctggaaaggaaaaaggtcctaaggacactttgatttttcatgtttgatccccaaaacagcaagataatttgtgttggtttaggtcactaagcttatgacaatttgcttagaaacagaacacaaatacaattgctcctcagtatccatgggggattggttccaggaccccctgtgtataccaaatgcctcagatgctcaagtccctgatataaaagagtagtaatttcatataatcttcacactccttgcatatactttaaatcattcctagatttcttgtaacactgaacacaatgtaaatgctaagtaagtaggagttatgctgtatttcctagaaaataatggcaagagaaaaaggcctgtgcatgctcaattcagacacaatgtttttgtagaacgtttcctgatgtggaacacacgaataggaagggcctactggtttcaaattataaactgagcataaaattagtaacacaaaaaagctaaggctacatttctgtaatggagaacaaagatgaaaacctaccaacattttacggaattttatgtatatctttctcaaattctgaaggcttatatgaaaagacaatgaggctctcaggaagaagggacaaaaactgaaaaagttgagcctgttcctcagtttccatccaaacggactcactgctatgggaattgccctcctacagtagacaagatggaactagtcagcaggtgtgagacagctgtgttcatatattggataataagcagtgcaacaaacaaataaactaggatgtccttttgcccctagctctctatagggccaggttacaggccacagcacagggaggaagacttacatgaagaccagcaccctgtagcattgaggagaccaaggtcaaagctcacacagcacgatacgccctgtgtcagtctgtgtgtgttgctctaaaggaatacctgaggtgggataatacttcaggaaaggaagttatttggctcactatttttggctgtgtgagaagcatggtgcctgcatccgctccttgttaggactccataagccttcagtcatagtggaaagtcaagtgggagcaggaatatcacgtggtaagagtggagcgagagggtgcaaggaggtcccagactcttttaaacaactacatgttgtatgaactcggagcaagaactcactcatttttgtgatgaaagcagttagtcattcattagggattcacccccacaacccaaacacttcccaccagattccacttccaacactgaggattagatttcagcaggaggtttcgaggggacaaacatctgaaaaatattattcttcctctggcccctcaaatctcatgtccttctcacattgcaaaatgcaatcatcccttcccaatcactccccaaagttttaactacttccagcattaacttaatcaaaagtccaaagttcaaaatctcatcccctgagactcaaattccttccgccttttagcctgtactatcaaaaacaagttatgtactttcatgttacaatgatggcacaggcattggctagacactaccattctaaaaggcagaaattggccaataaaagggattacaggccccacacatgtcagaaactcagcagggcagctattaaacctcaaagtttgaaaataattcttgattccatgtcctttattctgctgtgagggtgggctctgaagaccttgggctgctctgcccctgtggctttacagggtgcagcccacatggctcctgtcacaggtcagaatctgatgcccgtggctcttccatgctgagggtacaagctgtcaacagtgttactattctcaggtctggagggcagtgttccccttccctcagctccactaggcaatgccccactggggacactgtgtggggaatccaaccccacgtttccccttagcactgccctggtagagtttttctcttggtactctccctcggcagcagttttctgcctggagaaccagactttgccacacatcctctgaaatctcggtggaagctgccaagcctccttcctttttgcactctgcagacttgcaggcttagcaccacatgaacgctgccaagacgttctggctttcacccactgaagcagtggccaatctgtacattaggccctttgagctgaggctggaggctgggcagccaggatgtgtcttgaggctgagcagggcagctgtgcctgggtctggccactgaaaccattctttcctcctaggcctgtgggctgtggtgggagggaatgcctcaaagttttcaaaaatgccttgtaagctttttccccattgtcttggctattagcacttggctccttctcagtcatgcacatctctctagcaagtggtttctccacagccccttacagtcctcttctgaaaatgctttttctttctctactaaatttctaggctgcaaattttccaaatttttatgctttgcttctttcatgcgcgtccgtgtgaagagaccaccaaacaggctttgtgtgagcaacatggctgtttatttcacctgggtgcaggcgggctgagtctgaaaagagagtcagcaaagggagataaggatggggccgttttataggatttgggtaggtaaaggaaaattacagtcaaaggggttttgttctctggggggcaggagtgggggtcgcaaggtgctcagtggggttgctttttgagccaggatgagccaggaaaaggactttcacaaggtaatgtcatcacttaaggcaaagaccggccattcacacttcttttgtggtggaatgtcatctgttaaattggggcagggcatattcacttcttttgtgattcttcagttacttcaggccatctgggcgtatatacgtggaagtcacaggggatgcgatggcttggcttgggctaagaggcctgatattcctgccttcttatattaataagaaaaataaaacaaaatagtgttgaagtgttggggtggtgaaaatttttggggggtggtatggagagagaatgggcgatgtttctcagggctgcttcaagcgggattaggggtggcgtgggaatctagagtgggagagattaagctgaagggaagtcttgtggtaaggggtgatattgtggggatgttagaagaaacatttgtcatatagaatgattggtgatggcctggatacgcttttggatgaattgagaaactaaatggaataacagaaggagaaaaacaggtataaaaggtctaagaattgggacgactcaggatatctgattagagagtgcctaaggagactcatcatagtcctgccagcaaagattatttatgtacttcaagagttaagagcggcagtttggggatagcaccaggagatatcagctgtgatggcttggaaaaactgtgtaaaacggccgtgtaaacaagagcagggcatgtatgagtagttgagaacagtgaataggagtatgactagacagaagatagtagggatgacaagttttttggggcacagtttaagttggtctggtgtctggaatgagactggggcctaataaaaaggagcgtctatacaggagcttaaatgggctgtaccctgtagcattccgaggacaggcctgaattctgagatgggagagtgctaaaagtattgtccagtcctttttggtggctgagcttggtgaggtgtgtttttaaaagacctttagtccattctccttttcttgaagatggaggactgtaaggaatataaaggtttcactgaatactaagagcctgaaaaactgcttggctgatttgactaataaaggctcatgtgttatcagactgtatggaggtgggaaggctaaactgagaaattatgtctgacagaaccaaagaaatgactgcggtggccttctcagaccctgtaggaaaggcctctacctatccagtgaaagtatctacctagactaagaggtattttagttatctgactcagggcatgttgagtaaagctaacttgccagtcctgggtggggcaaatccttgacttgatgtgtagggaagggagggggcctgaataatccctgaggagtagtagaatagcagatggaacactgagaagttatttccttccttgaggatagatttccacgatggaaaggaaataagaggttctaagaggcgggctagtggcttgtactatagtataacctgcttttgctggtgtgtggcaattaggcctggtggaactgccatcaataaatcaagcgtgatcagggtgaggaacaggaaagaagcaaatatggggaaatggggtgaatatcaggtggatcagagagatacagtcatgggggtcaggtgtggtatcaggaataatgtgggaggccagattgaagtccgggccaggaacaatggtaattgtgggacttaaagagtgagtacagctgaaggagccggggagcagaaagtatataagtcaagtatgaggaagaaaatagattttggaagttatgagaactgtagagagggagttgagcatagtttgtgattttgagggcctctaaaagtattaaagcagcggcagccactgcacgcagacatgagggctaggctaaaacagtaaggtcaagttgtttgcacagaaaggctacagggtgctgtcctggctcttgtgtaagaattctgactgcactaactatgcctaggaaggaaaggagttgttttgtaagggattgtggtttgggagattaatcggacatgatcagcaagggaaagcacatatgttttcatgagaactatgctgagataggtaacagatgaggatgacatttgggcttgactgaagtaataggggctgtctatgaagccttgcggcagtacagcctaggtaatttgctgagcctgatgggtgtcagggtcagtctaagtggaagcaaagagaggctgggacaaggggtgcaggggaatagtgaaaaagcatctttaagatcaagcacagaatagtgagttgtggaggaaggtattgaggacaaaagagtgtacgggttggacaccacaggggggataggcaaaacaatttggttgataaggtgcagatcatgaactaacttgtaaggcttgtctggttttaggacaggtaaaatgggggaattgtaaggagagtttataggatttaaaaggccatgctgtagcagacgagtgataacaggctttaatctttttaaagcatgctgtgggatgggatattggtgttgagtggggtaagggtgattaggttttaatgagatggtaaggggtgcatgatcggtcaccaaggagggagtagaggtatcttatacttatgggttaaggtcgggggatacaagaggacgcaaaggagactttggattgggaagaagggtggcaatgagatatagctgtagtccaggaatagtcagggaagcagataatttagttaaattgtctcggcctaataagggaactgggcaggtggggataactaaaaaggagtgcttaaaagagtattgtctaaattggcagcagggttggggagttttaagaggtttagaagcctggccatcaatacccacaacagttatggaatcaagggaaacaggcccttgaaaagaaggtaatgtggagtgggtagccaccgtaatgattaagaaggggacggaattacccgccactgtgagagttactcgaagttcagcgtccgtgatggtctagggggcttctgaggcgatcgggcagtgtcagtcttcagccactaagcggagaagatctctgaaggagtcagtcagagagccttgggccagagttccaggggctgtgggaatggctgccaggtgagttgaacagtccggttttcagtggggtcccacacagatgagacgcggcttaggaggaatcccaggctgtgggcattccttggcccagtggccagattttgcatatgtagctagctcctgggggaggaggttctggaggactgcctggctgctgtggttcaggcatttggaagttcttgtgtgctggagatgtggctggggtttgtctcacagtggaggcaaagaattgcaacttttttctgttattgtacgccttgaaggtgaggttaattaagtcctgttgtggggtttgagggccagattccaatttttggagttttatttaatgttgggagcagattgggtaataaaatgtatattgagaataagacggccttttgaccttttagggtctagggctgtaaagtgtctcagggttgctgccaaatgagccatgaactgggctgggtttttatatttgatgaaaaagagcctaaacacttctgatttgggataaagaaaaaggagcattaaccttgactatatctttggctccagccacctttttaagagtaaattgctgggcaggtggaggagggctagtcacggaaggaaactgtaagccggaccaggtgtgaggaggggaggtgataaaaagattatagggtagaggagcagaggctgaggaagaattgggacgtagcttggcctggtgaggagcagcctggggaggaagggagatgtcagattggtctgtagaaaaggaagattagaaagactcagcgacacttggggttggtactgaggggacaggcgggagggaaagaaggaagatttgggatgagttgcactgggcacagagactaggaagggactgatgtgtaaaagaatgcctggacgtcaggcacctgagaccatttgcctgttttacaacaagaattatttagatcttgtaggatggaaaaattcaaagtgccattttctggctatttggaactactgtcgagtttgtattggggtcaagtggcattgcagaagaacataaggcatttaggttttatgtcaggtgtgacttgaagaggttttaagtttttgagaacacaggccaagggagtagaaggaagaatggagcatggaaggttgcccatagtgaaggaagcaagcctagagaaaagagagagtagagaaatggaaggaaggggtttgggggttcttaccttccagaaaagtgggaaaaggggttggggcacagagataagaggtcagggcatggaaataagggattggggtgcagagatatgaggttgaggcactgaaataagggattggggcacagagataagaggttggagtgcagaaataagggattggggtgtagagataagaggttggggcatggaaataagggattggggtgtagagataagaggttggggcatggaaataagggattggggtgcagagataagaggctggggcgtggaaataagggattgggtgttcttgccccatagaaaagcgggacttgccgctaagggtgaaggagaaggggttgaagggtacttgcccctctcccagaaaagcagagaaggggtagagacaaggcgagaaggagttgaggtacttgccccttccccagaaaagcgggaattgccgctaagggtgaatgaccaaggcaggtgttcctgcatggtcagacacccttgaaacgtgggtgtataatcagagaggcatccctgcaatgattaaacaccaagggaaggctgccttcccagtccgtgaccagtgccggagttttgggtccatggaaaaaacgtgtctcctttgtctcttccagaaaatgaaaggaattgaaattaagagaagggagagattgaagagtggaaaggagaaagtggttgagggacagtgagagaggttgcagaagagagtaagaagaggccgcttacctgatttaaaattggtgagatgttccttgggctggtcggtctgatgacctgaggtcataggtggatcttctcacggagcaaaaaacaggagtacaggggattgatctcccaagggaggtcccccgatccaagtcacggcaccaaatttcatgtgcgtccgtgtgaagagaccaccaaacaggctttgtgtgagcaacatggctgtttatttcacctgagtgcaggtgggctgaatccaaaaagggagtcagtgaagggagaaaagtgtggggctgttttataggatttgggtaggtaaaggaaaaatacagtcaaaaggggtttgttctctggcgggcaggagtaggggttgcaaggtgctcagtgggggtgttttttgagacaggatgagccaggaaaaggactttcacaaggtaatgtcgtcacttaaggcaaggaccggccatttacacttcttttgtggtggaatgtcatctgttaaggtggggcagggcatattcacttcttttgtgattcttcagttacttcaggccatctgggcgtatacatgcaagtcacaggggatgcgatggcttggcttgggctgagacgcctgacagcttctcctttaagttccaaattgaaagcatttctttgctcctgtatctgattgcaagcttgtagaagcagctacatatcttgaatactttgctccttggaaattacttagaccagatgctctagctaatcactctaaagttcaactttccacaaatccctaggacgtgaacacaatgcagccaagctcttgactggggtgtaacaatggggacccttgctctaattcccagtaacttccacttttccatctaacaacttgatagtgtggactccactgtccatatctctgtgagcattttggtcacgtacatttaacaagtttctaaagagttccaaactttccctcatcttcctatcttttgctgggccctacaaactctttcaacctctgccagtacccagtgacaaagccacttccatattttcagctgtctttacagcaatgccccctgcacagtatcaattttctgtgtcagtttgtttttactcctataaaggaatacctaatgctgggtaattcataaggaaaagaagtttattttggctccctattctgtaggctgtatgagtagcatggtgacatcatctgctccttttgaggcctcagaagacttccttttgtgtaggaaggggaagggggagcaggagtatcacaagccaggagaaggagccagagttggggaggtgccacactgtgtgaaacaaccagatctcccatgactcaaagaaggagctcacagattatctccaggacagcaccaagccattcatgagggatccaccccaatgaccccaacacctcctgccaggtcccacctccaagactgggaattacatttcaacatagtatttggagagtacaaacatccaacctgtatcagaccccaatttccagtgcacatatcagagagtgggctactgaaaggaagcattgatcttgagtgttggagaagagaagaatgccttcactcttaggctatgttatgatgtgtgcacacttgggctaagacttccccaggccagaaaaaagtaaaaactccataagggagtgaacggcattttcaggaggacagacaagtcttgaaaactttgtatccccacagcaaagtggagagaactcagaacctcagaaagccatcagcaagtagtggtgctagttagctctagattaaactgctctgcaactgcttcaagaaattttcaagccattcttgaaaaaaccaaatgaatgtatagaacccccaaaatgaaccagatgatgtctagcattctttggggaaaacaaccaaaactgttactcaacaattcaagctgtccaggcctggcggttcatgactgtaatctcagcactttcggaagccaagacaggtgaatcacttgagggcatgagctcgagaccagccaggccaacctatgcctactaaaaatagaaaaattatctgggcgtggtggcacaggcctgtagtcccaggtactcaggaggctgaggcaagagaattgcttaaaccagggaggcagaggttgcagtgatctgagattgcaccactgcattccagcctgggcaacagagcaagaccctgtttccaaattaaaaaaaaaaaggctttataatatactgaatccaataaaaaatttccaagcatgaaaagaagtaggaaaatatagcccataactaggagaaaagtcattcagtaaaaacagacccaataatgacaaaggtactaggatcagaaaagggaatgtaaaggagctattataaaagttataaatatgtcaaaggctgaagagaaaacctttttgatgaggaggaacacataaaaagaaccaaatgggccttccagcagtaaaacaaaatgatgagaacaaaaaaatttctgaattggattaatgacacatgacagtatagaagaaaggatcagtaagcctgagtctacattaacacaaacaaatgagaaaatgaagcaaagggagaaaaaaactctggatgaaaaataaacagtgcacttcacagaaatatcaagcaatctagcacctatgtgtgtttgaaggcagaaagaaattccaggagaaagcataaagttagtgaaataatagcctatttttataaatttggtgagactggaaacatacaaatttggtattgaaagacatccaagaagaataattatttaaaaaaaaaagaacaagaatatcataattatacaagttcattttcacactgctataaagaactacctgagactggataattataaataaaagaggtttctttgactcccagttatgctggattaacagaaagcatggctaggaggcctcaggaatctcacaatcgtgatggaaggtgaagcagaagcaagcaagtcttccacagtgtcagacgaaagagagagggagagagagagaggaagagagacagagcacaagagtaagcacagaaggaaactgccatttataaaaccatcacatctcttgagaattcactcactatcatgagaacagcaaggcagaattcacctccccatgatccaatcacctcccaccaggtcctgccccccaacactggggattatgggattataattccagatgagatttgagtagggacacagagccaaaccatatcaataatcaaattgttttgaatcaaaaataatgagaaaatcttaaaagcatgctgagagaagacactgcttacagaagtagaaaaaataaagtgacatatttaagtaccaaaagaagaaaaataagtcaacataggaccctgacaagcaaaaatacatttctagattaatgctaaacacatattccagtaataagtaaaggcattttcttttcctttttttttttttttttttgagacggagtctcgctgtcacgcagactggagtgcgatggtgcgatctcggctcactgcaagctccgcctcccgggttcacgccattctcctgcctcagcctccccagtagctgggactacaggcgcccgccaccatgcccggttaatttttttgtatttgtagtagagataggatttcaccgtattagccaggatggtctggatctcctgacctcgagatccgcccaccttggcctcccaaagtgctgggattacaggcgtgacccaccgcgtaaaggcattttctaatgacaataacaaaaactaagagaattcctcactagcaaacttgtagtataaaacaagacccaaatacacgctgtctataaaaacccaatgtctttatcaaatataaggacaaagataggttgatagtaaagggacagaaagagttatagtatggaaacattaatctaatgaaaacagaattagctgtatcggctaactgactataaatcaaagtagattttacagcaaggtgtattattactgataaagagcctatgttttccggtgataaagttgttaaatcaccaagaacacatatcattattattaaattagtatgcacctaataagagagtctcaaaaattttaaaaagaaattgatagaactaagagaagaaattgaaaaattaagaattaccattgaatatttcaacacttttttctctgaaatagttttttttagcagcaaagtataaataaagatagagagaacttgaacaacagtatcatccattatgacctatataagctttacaggacactcctcccaataacagtaaaatgcattaaaatattatctaagagagctcatattggactaagaaacaaaaaaatcaaaacaatttaaaatcatgtgaagcataatgtctatccacagtggaatgtatgaagctgtgactaaaggaaaatagctggaaaattcctcacatatttggacattactcaacatatttctaatgagtcaaaggagaaatttaaaaatattttcacatgacagcaaatggaagcataacataccaaaatttgtggcaatacaactaaagcagtgcttggagggaaattgataacattaactgctattataatgggaagtcgaaagctcagaaatagacaatctaatattccattgtaaaaaacctggggaaaaaagaactaattaagctgaaagtaaataggaaaacgagtgaataaaaaagaatgtggacacaaaagagaacattaaaaataaataaatgaaagctacttgcttgagagaatgcataaaattgtgagaactctcgataggttccttaaggggaaaaaggaaattactagaagtctcaggtgcacacccaggcttcaggcaggcaggaaacagattaggtctgcgtttcagggtcatgtagtcaagccgccacgaggtggcagtaactgcgcgctcattccctcacctcctgcaaggccgggccaggctgtggactcactgctcagctcaggagatgggagagggtgacagtagccgcgtggactctggccttaggcagagcgttactgtagctttggggttgtaggaggatgaagaggggaggttatcaggacaccatggtgattgtgtggtgctggttaggaacatgggctttgaagagagagggattttatttcaaattccatctctgccacttagtagtcagatgaccttgaacatgtcctctaacctttctaggccccaggacctgcctctgtaaacttgggtaataaccccctggcatgtttgcttctgaggattaaatgagataacttgtataaaaatggccacggcagggccggctgcaaaattcccaaggctcagtgcaaagtggaaatgcagggcgccttgttcaaagagcagcagaagaaagtgtcgtgaaaggcaggagggtattcagctttctcaagccagtatgtttcatcatttgaaaagtgtaatagggataatacttctagaagagtaagaacagaatcatataaatccccaccagaaaccagtgtcacagttttaatagaataaataataatactttattaattggatctagatgaatgaaacaatttttctggccaacttttctgcaattaatttattaggtcatcaaactttataccttgagcaacttcattttttcttctgaaaagaatctgctgaagcaactgtttctggaatattatctaaactctgacaatattgggataaactattttgacacaaattttagtatatctgtagctggtggttcttgtggagctatttttttcaaaggatttaactgtttaagcaaatcagttttatggaagtttgaatttaattttaagtgtaaatttctccaatggaattttgatgcatcttctgacatgttctgtaagttgcagaggcccacagcagaccaaatgtggcgtcatgatttgtaacttactcaaaactcctgtttttgaattctattgttgtatctttaacaagaagaactgaatttttaaaattgctctacttgttaataattgattgatcagaaatgttcttttcttttcttttcttttcttttgaggtagggtctccatctgttgacatgatcatggctcactgcagcctcagactcctgaactcgtatgatcctcctacctcagcctcccaagtagctaagactacgggcatgtgccactgtgctcagctaatctttttttttttttttaatgttggggtctaactatactgcccactatactgcctatggtggtctccaacaactggcttcaaacagtcctctaaccagagcttcacaatgtgctgggataacaggtgtgacccaccatgcctgtcccatcagaagttttgtgactatcattatatatttaatttatatttctgagccttggataactccttgaagaactctaaactctctgaggaattccaagaactccctggcatactatttcacagtgtccatgggcacacttttgttttgtgcttctctcctcccaatttgctatctgagccctatgattcctgtcccggcgctcaggtcagggggtaaatattcgtgcagaagctccaaggatgactctgagaatgcacaggcacagaggtgtcagtgctgcgtccacacagagaccctcctttcaccccagggctgaggacacctgctgctgctgctgccacctcccatcctggtccgttgccatcttccttcccagtcgagatgtgcctgggccgctccaaggcacccgtgctcagggcagcaagctccagcatgtggccttcatgtccctgggcctgagcctgcccaccttgtcccccctcatagccactctgctcatgtgcctgctccattgtctcagtgggcttcacttacaaaatgaagttcaaagaaaaaaaactaaggtcaagagggtgtcggcagagcctgctaccaggcactggcccttctgagggcaggtccctttgtcactgcccagccctcaagcccatgaagctggtcctggctccagaattgagagccagtaaaactgcttctgttatttatcattgaggacacagtgcagagaaactttgctttctaaaattatagatatgagagactttgctttctgggagcctatctaaaggaatgcccactcttgcctggggaactgagccactttgccacagaaaacagcctgtggtttgggaaaaaacccatatctgttctggtggatagtcttccttgctgaagcaagataataaccctacctttaagacaaaagtgctcctcccttgatctttatcaaacacactgtatcaccaggatgaacactgctctgaaggagtcacatcgggctgtgccaggaaaaaagaatagctgcaaccataggaatcttcatgggaacagtcagcccagctgtccttgagcaaccaggcccatgttccctaagccttggtggcttcttccccagggacacaggtgctgcatttcacagtgactttcctatttcagagcaatttcacctccttctctaacaaggcctcacaaatgtactgagagctagagaggacaacaagtgtaaaaccacagtgctgtcagtggttcctgggattgcaacgggattataggagaaattcacactcttctatgggtgagttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctatgggtgagtttttaaatgcaagtgtattacttttataataatcatgttaagtacagcagtcattaaggacgtatcaatcaggagtgatgccacacatgaaaaagatgggaaccactctcttaactcaaactcttatttacatataagagttatgtaataactccagtaaggccccttgccacataccatggcatttccttaagaatgtttactcaacaaggaaagaggcgtgacaacctaattcgatgtgtgaatctggattgaacatgtacccagaaaactcaacagccacaaagctattcttggaacaatttcaatgtctatgcactgacttctgttttgcaataatttactgacactttgcttcctgagcacctacagctgctgtcccagtgttcaggccagggaaattttcttgttaatgtgcataaatggtagtgtgattgatgcgggaatttttttcttatttataagagatccatgctgagataattagggtgaagtgtcatgacattttcctgctactttcaaaaggtgacagcgacatagaaagtatatattttaaattatttattaatttagacagagcacatatgtgctttttttttttcattcagtttttctatttggcttccttggccaggaatagttttagtgtcaggaaatgaatgagtctgcccctcaattccagcctgctcagcacagaggaaaacaaagttctgacaaagggagtgactccctgctgagtcagctgcagccctggattcagattcctttagcagttctgagggcacccaacccagccctctctttgcctaccccatcggaaacttcctttcatgataagaaagacattaaagatcttgttcatagaatccattgcagctttctttaaaaacacccctggcctgcctcaaactgtgaattcttaaagtgtgacatttaagatgtagaccatggctcaaggctcattgtccccatggctgtcaccgctacaccttggtgtcatcgctacacctgacactggggcctgcttgtctctcaaacttcccttggatccaaagagggaggaaccaggatgaatgccacttattttcccttgaaaagccccacccctgagcatctgacaccaggggctctgtccattgcctgtggccaccgattgctactctgggttatggaggaaggacagggtcctgagagtccccagagaccttgcacagctctgaaaacacagggcttctgcagaagtgggtcccatcaccaatagggagactgtcagacctctgagcccaagctaagccatcatatcccctgtgacctgcacgtatacatccagatggcctgaagtaactgaagaatcacaaaagaagtgaaaatggactgttcatgccttaactgatgacattaccttgtgaaattccttggcctggctcatcctggctcaaaagctccctcactgagcaacttgtgacctccacccctgccagccagagaacaaccccctttgactgtaattttccattacctactcaaatcctgtaaaacggccccacccctatctccctacgctgactcagcccacctgcacccaggtgattaaaaagctttattgctcacataaagcctgtttggtggtctcttcacacggatgcacgtgaaagacaccacgtggaggccttgcacccccactccgtgcttctctaccaaatcccaacggtattgagctcacttagcactgacgtctgtggaaagcagggaaagccctggctcccaaagccctgaagtcctgtggagctgacattccctgagtgacggtgtgaacggagggaactcaagtgttagtggtaggccacctcctggcctgggcctgggtggactctgaggggacacatgtagtcacaatcccaccctcccattctccttctcagaggaaggaagtgggcacccatctgcctcatctctgtcccatggtgatgacggagaatttcagggcacctttcacatgaatttcaccagctcagatctgtgaggacggggcccaccatgctcctggagctgccagaagccgtgagcccctcccaggtccctgggtttgagccagccctgtatcatccccaggagctgaatgtcccagcaatggatagaactagatggaaccggctcccagtttggcctgagactgtccctagacattcaggaaaaacaggacatcccacagagcgggcaggtgatctccagttcacagaccctgagtctgttcccctgtaagaaagaccttgcccctcactccattcacatcccaggtcccaaatggtacaagacagaaagaagccctggtcatatgagcagaacgaggggatgttctggggtttcttgtgtccaaatttgcataagagctcctgggtatacttttctctcagagggccatttgtctgatgcccccagtaaggtggtcagtttcaatcactgtaattactgatgtggtaggcaatacctgttccaaattctgcccagtgaccaggggccaagacctgtttagatggaaggctcggtgtcctccccagcctcagctcatggtgaagctcccagccatcacccataagggtccttatcttctcttctcattccgcttcatattcctgatgcctcttccacatgagatgagtcagggaaataagaggcttggaaaagtggaaaaatggggtagaggctctctcttgcctctctctcacctctttctctctcatccaagtactagttaggcccactcctgcttagcttacaagatcagaggagatcaaacatgttcaaggtgctatggccgtagacactctctctctttttctctgtctctcatgtctatatctctcctttgtctcctttctctgcctcttgtatttctctcagtgtcaggacactccctctctccctgtctcccctacagcttgactccttttgtccctttctctctttcttctactatcacttctagactgagtagattgcatgccttactttgttgaaccaaactccatttccttcaatatgaaaggagtttaagagcttcatggctgcctcactccctcttctaagccagaggggcccagtagcctgtaaatctcatctcctccctgatcttcactctatgactgctaagactatggttgaaaactgtcaggcgacttttatttttcaataaaagtgagaaattttgattttatccaaagaagtaagtacagaatgtcattttctaaatttttatatttaaagtgtagatttgagtgacctagagaatttcaggtagtgataaggcgcagcctgtactttgggaagttgtgtttgggacactggcccttcgtcttttcagatggaaggccctggagaacacttgccctctgtggctgctctaggttcacaggacaaaaatgcttattgaaagccacttttaaaatggaatgcctaattttattttctccttgatattataagaataaaataaaagggtgaaggaagaaaaggagagtggaagggaggaagggagagagaaagataatttgagactaagacctgagatatctaatctgatagaaattacatagaaaaagcctcattttatccatattgtttatgggttttgggttacagaggagcagcagggctcctggaggcacagacactgggcgatattccaccacttaggagagtatgaaggaagagacaaaagggaggaaaggaggaaaggaaggagggaggacaaatggaagagtgagattgagaacagaatttagagattagaaacaattcattacaaaggtttacttctactgttaattattgtttttaattgtaatctactttcttttatttgtcttttttcattcccagctcccctccccctgcccctccttgcccctccttctttttttttttttttctttttttttctgagacagaggcttgctctgtcacccaggctggagtgcaatggcatgatctcggctcactgcaacctccgcctcccgggttcaagtgattctcctgcctcagcctcctgagtagctgggattacaggtacccaccaccatgcccagttaatttttgtatttttagtagagacagggtttcaccaggttggccaggctggtctcaaactgctgacctcaggtgatccacccacctaggcctcccaaagtactgggattagaggcgtgagccactgggcccggccctaagttactttcatattaaattcacattaaacaatttctgccatttgagccacatctttttcttgcatctcattttaaaaacttaacggacttcatgatttggaaagcagaggttactggcctgtgtgtgtaaatggaggtagggtagctttgaggttatttttgtgtggtggagctgaattctcaagaaatcctagttgagctgctacctgagcccatctggaggccccagtcacttagcagagatcggtctttcacattctggttccaggaactaaacattcccaaaccacgtcagggccagcctccttttaagaaacttaggttcacgtcatcattcactcatgtctcatgatcatgatcaaaatcccaggcttggaaaagaaactcaccagagatttattcaagtcaacaccgacacaggctttgtgcttttctgacatggggttttgaattctaacaccctatcactcctattgtcctttgatttgcttattgtttattgcttctgggttttttttcttttttttcttttcctttctttaggtttttctaaagatataagaaatcctgctagctgacacaggaataaaggtgtgtgtgtgttctgaatgtttgctctacaagcttgaaacagattggcacctatggccatgacagaataaaatgctgcaaaaagtaacgaggagtccaagaagtttctgtgactaatgtggattcagaaagggctcactcagcagagacgtgccacatttaaaccaaattaagctacggtgttcgaagacatggaatctttatcctagtaattgtaattgtgattgtgtaacgttggtttcggactagcgaatctctgacatctttggaatgtccttcccagctctccagaccaggggtcagggatggcacaggaggagttttttgggttgctcctccagtaacccaaaaccaacaggagcaacgggatattagaattcaaaaccccatgtcagaaagacacaaagtctgtgtcagtatcatcttgaataaatccacggtgagtttcttttccaaacctgagcttttccatcatcatgagatgtgagtgaataattatgagtcataagtttctgacaaggagactggcactgctgtgatttgggggaggcttagtgacatctgttccctttaggtcccttgaccttccccaattattcccattgttttcctataactgtgctttgctcctcctacttcctctctttgcgtgccctcacctaccccacatcttcctggaagactgtgcctcattaatgtcccaactcaaaggcctctttcctcctggaatcagggtgatccactaaggagggaacgtcctatcctcttgttcttcacaagcactccctccttctggtttggcctgcttatgcaattgtgcttcctgctcatgtggataattttttacttctccaatagtctatgagctctctacaggtatggactttctcttattcatgtatgtagtggtcattgaggaagaggtgttacttcataaattattatacatttaatggcaaagttgagttgcacaaagcatttcctcacatctagacataattttgattcatgtaaaagctcttaaaaacaggtcctttttgaaggtacagttaaatgagggcaatatagcacagaacacaatgagaggagagcaaacctcaagaagaaagacagtatagactctgaggggaagcatcaagatgcctgcctagccctgccctctctcattgggcagtttaactcgtttgatagttaaatcgtgaactctgcaggtataccctacatgtctatgaagctctctgcttcttgatattaacttttctcttaatgtgcataccatcaacctctagctaaaggcatttttgtctaaaataatccattggatttcctagagtatcaagattggaaaaaaaaaaatcagacctagagattttttgtagatcctttaaccaggccaagaggtgagggaggcactggatgcaggtgcagaatttggggatcaaaaaattctgcactcaagataagtgatcttataatgtatgtgtttttttttttttgtaaaaaaaaaaaaattgattcaaaagtaacacatgatctacaaaatattcaagttttaaataaggacagaatctaatcctgctattgtgcaactcaaacttacccacctcaccttggtcccaggcctgtccgatagtcttatttatttaaccatttaatttttataatatgtgacattattagtttgaatgaatttgttgctctcctggtgcctggaagtttaggtagagtttacattatatatcccatgatatttgcaatgtccatatactaaaaagttattcacagacatttttctccttaaagacaatttttgtggccaaagtatttatttgctacactgagttttattttactaggtgtagtaggcataataatggcctcccaaagatgtccatgtcccaattcctagaacctatgattatgcttctttacatagcagataagaattaatgtcagcagacagaattaaagttgctaatcagctgactttcaaatagggaggttatcttagattaggtgaacgagaccaatgtaatcaaaaggatcattaaatttggaaagagacagaacagtcagtgtcttcgtgatgtgatgttagaatgacttgacaggcattgctggctttgagatgaagaagctacaggccaaggaagttgggcagcttctaaagcttgaaaatgcaaaacaaaacaaaaaagcaaacaaagattctcacttagagactctaggaaggaacacagtcttgctgacaccttgattttggatattttattcccccgaactgtaagataattaattagcattgtttaaagtcactaaggttaatgacaatttactacttcagcagtaattaacaaatatagttgctccttggtatccgggggggattggtttcaggtcctctgtggatataaaattcctcagatgctgaagtccttgatgtaaaatggcatgggtattgtcatataacctttgcatttcctcctatgtactttacatcatctctagattacctgtaaatcctaaatcgatgtaaatgctaagtaaatgggtgttaacttatattgtttagggaataatgaccaaaaaaagcctgtatatgttcagaccagacacattttttttttcctgagtattttcagatcaacacagagggtcgactatatcctagtttcaaatcatgaattgagcataaaattagtaacacaaaagacctaagcctacatttgtttaatggagaaaaaatgatgaaaaactcacaacaagttactgaactttctatgtttttttcctagaaatgagcaaggctcacatgataactcttcctccctcagaaggcactctgagctcagtattacatgaatagcccatttatttcagatctgtagcttggaatttattgtgaacagattcagtcttaggtgagggtggaagacatatgtctccattccctgatttcatatctccaggatattcctacaccaaaagcacttcctccatagaatttgcaaagagtaaatatgtactgtcagagatttattcttatggttcaagatctaattctttattaatcaatcacacacctccaaagtgctattcttaaaaaacaaacaaacaaacaaacaaaaaaacccaaaaaacagcaaattgctgccttgcaaaacatcaggctgcctttaatgccttcaatcctcatctgagttccagaagtgaaagatcataatccataaaaacctgaggtcaaaaatgtacgttcttagaatctgcatttgtgtagaaagtgtcagactcttaagaaggtagcaatcttggcttgtcacttggctggtcagccaccagctatgaatgtcagttacctgctcttcactttgccatttttgtccttgttgcctgctccagataagagggagctgagaaacaagagggttgacataaattgaggttagattgtagtttattactaattctttctctagaccagatagactatttgaacagtttgtgaaaactaagcaccttccctttaacattgaaggtacatatagctttagaggaggtttcagagttttacgttttcatggcccaacctaacagactgaaattacctgtgatgatcccatcgctttttcttggcaagactggggtgcctatatttaagggataagtgccattttaaatggaagtaaaatgattaattttatttcaaggatagaaattctggctatctctttacgagtatatccttttataattaaatggaagagttttggggcacctagagaagctcataatatatgcctggggcactttatacagtgaacccttgccataagtgccccatgtggtctcttcactgttctccatcacaactttggctttcagatgactttagcttcgctattcctttattttgtcccggcatgtattgaaagagaagttaaaaaaaaaaaaagacagggcactgaaagagagagagagagaaagaatggtaagaaaagacagaagggatggaaaaaggaagaaggaaagggagggggaaaggagagggaggaaagcagggagggaggaataaagaaaagggagggaaggaaggagagaggaaaggagggaacaaaggtgggaagggtaaagagggaagaagagagaaagggtcgtagatcgcatttccttgcttactcatagacaggactcgtattagcccatttcacaccgctataaagaactgagtaatttattaaaaaaaaaaaaaagataggtttaattgactcacagttccgcagggttggggaggcctgaggaaacttacaatcatggcagaaggcaaagaggaagtaggcacatcttacatggcagcaggagagagagagaagagggaagcaccatttttaaaccatcagatttcatgagaactcactcactattacaagaacagcatgggagaaactgcctcctcgatctaatcacctcccaccagatccctcccttgacatgtggggattacaattagagatgagatttgggtggagacacagagccaaatcgcatcaggactccagcaattctttctctcacctaatctatctcttattcccctctactgcatctataccaactaaaagaaaaacacttattggacacacaagagctctcgtcttttgcatttgcccagcttttcagggaaaccctatgaaaggggtgctacacagtccccacatcctaccacccttctttccctcactgccactcaaacctgacttctgtcaatagggtcacaatgccttctgcatgacctcactaagctctgcctctgcccattgatatgacccctaattatgtggtcactggagctgctttcaggtgtccttgtcccaagggacatacagcacacagcctgtggagggtggaggaaccaactgcaaggtgggtttccagtagggccaactggggctaaagaaggggtgggaggcaataaagaggcttgctttcagggtgtaagtgtaggagacaggaatgtagacaacagatttcagcctccactttactttctagtggtattattattattattattatcagtagtattatcaccatcattatttgctgtggtatgagtgtttgtgtctctcccccaaaattcatgctgaaatctaatccccaatgcaatagtgttaagaagcggaacatttgggaagtgattaaggaacactgacctttacccacttggcccaccatgacccacctgatgcagactttccccctttgttagggaagtgcaattcagacaaccttttatgcacgaccctgttcattctctaaacctcaagctctattgctgtcaaacacacagaactagtttatctcactagagatgtgttcctttattcaaaaaatattatctttcttttttagcaagaaagactgtaaaataagcaaaagttttgattgtggatagttcaaatcccagctcaatcactagttgtataacctgcattgacttgctcagagaaaatatctatctcatataaaagttatgtcaactaagataccactttcaagactcgtggtacgtgataggtgttcaagaatgttcattcttactggagtgacagaggagtttctatattattttattaaattatgtaaacttaagttatgctaacatttaataagtgaaattcagtgtgttcctacaattttaggccttatctacgaccatctttctcccacacccaaaatggccaaagtttccctaccagcctctaattccatgggccctaaaaggcaaagttgtccttattaagttttaaattttagggatttttttgagacattccaggccttatggaggaaagtagtatcttgtgtgatttcaggtatccagaagttgacttaaaagttcctcttacaggttaggttcatttgcatttctctaatgaccaatgatgatgagctttttttcatgtttgttggctgcataaatgtctttttttgagaaatgtctgttcacatcctttgcccactttttgatggggttgaaactcttgtggtgatcctagttaaaacacaactctgcgtggataggtattgggtagcaattgactcttcctaagatttttttttttttcctgagacaaacagtaggaggttgacactatagccatcaccaaataaacaggagacactggagctttgaaaggttgaattatttgcacaagatcactcagttgatgaatggcagagcaaaagttttgaaaccagggttatctgactttagagctcttttattcttaggtacaaaaaaaaattgtctctatttttgcaaagaccacagcttacatcagagcttggctgatttctctgatgtctacatctcatcaacaatctaccttttggcttctcaacacatactgattattaatgtagggtgaccactgttagagaggtcgaaaggtatgcatccctgagtttcctccctgccttccttccttcttttcttccttccttcctgccttagtccatttgggatgctattaaaaagtaatataaacagggtggcttataaagagcagaagtttacttctcacagttctcgaggttggaagtccaagatcaagacaccggcataggtgtctggagagagctcgttcccttctctgtgatgttatgtggtgaaaggtacaaacgagctccttcaggcctcttttataagggcagcaatcccatcacaaggacttcagctccacgacttaatcacctcctcaaagcccgcaccttgtaatatcgtcaccaccttgggggttggcatttcaacagatgaatggggagacagaaatattcaaacattcgggccacagcacttccttacctccttcctccctccgtcaatttattcattcatgtattgattctttcattcaagtgtcatttgtttaaacaaatacgtgagtacctcgtctctgctaggtacttctcaggggctgaggaagtaaggtaaccagacagtgcttgttactttagaagctcacagtgtagagaaggagagagatgtagaaacaatataaagcaacacagatgtggaggggaaagagagaaggaggaatttcagtgttttaccgtgtatactttctgctgtttaattcctttaccataaaaatgcgttgcactacatgattaagaaactctttggcccctaatgcgtcacctagttgtaatctatgcagaagtttgacatggtaagagcctgcctagaattatcgcttttaaccaggtagcaaaaaaaaaaaaaaaaatcaaacattgaactcaaccaaggaaaaaatgtaatttccatttacagaatttcttctccttttttagcttctaaaatgggtggttttccaaaaaaccaagtgctctcatttataagtgggagctagggtatgagtacaaaaaggaatacagagtgatatgatggattttagagactcagaaggccgcagggctaggaatacaaaactacctattaggtacaatgtactctactcaggtgacaggtgtactaaaatctcagaattcaccgctatataattcatccatgtaacaaaaaactatgtgtaccccaaaaactactgaaatttgaaaagaagagagagaatttaacctctccttaat

SEQ ID NO: 706 - DNA, 207718 bp, Homo sapiens
acgtgcttcttaaggatgttagtgtaatctaaatgcttctgaaggtttttgttttccaataattgtggaccaggcagcccaaaaagaacagctagaatatctgacatacacacacacacacacacacacacacacgcacacacacgcacatgtgcactttgtaggtattagagaaccaacagtaaagaattactaggtcaagatttgagagaaagaccgaaacaaaagcaggaacatcacattctactaacataaaaaaagttattatgaaggcctgaaacattttgaaatgaagaagacctaaatgagtggaaatgctctgttaaagcatttgaagattacttttttaaaaaaaattaatcttctggttcaaccaaataccatgggaatccccagaggttctaatttgacaaagtgattctaaattttatttggaaattcaaagggccgagaatagccaagacacatttggaaaaaaggtgagaggtcttgctttactgtatttcaagactaagtgtagagcgtctgtaattaaggcaatgtgcttatggcacaaggacagaaaaatgtccaaatggaataagatagagtgtagaaagaggctcatgcatacatggagaattgatgtagaatagtagtggctcagcagaacagtggggaaaaatagtcttatcaacagttggttctgggctgggcatggtggctcatggctgtaatcccagcactttgtgaggcagaggcaggcagataacttgaggtcaggtatttgagaccagcctggccaacatggtgaaacctgctctctactaaaaatacaaaaattagccaggtgtggtgacaggcgcctgtaatcccagccactcgggaggctgaggcaggagaatcccttgaacctgggagggaggggttgcggttagccaagattgtgccactgcactacagcctgggtgacagagcgagactcagtctcaaaaaaaaaaaaagttggttctggacaatcagatattcatattggggaaaaaaagtaacttgaccgttacttcataccgaagccacacacacacacacacacacacacacacacacacacacacacaccccattgccagatggattgtaagtctaaatgtaaaaagaaaaaggataagcttttagaagacaatattggggactatcttcatgtctttgatgtaaagaaagtcttcttaaacaagatagaaagtgcagtaaccttacggaaaaagacatgacacattcgactacattgaaatcatgataaaagcctcttttctaggaaagtttccattaagagagtgaaaaatcaaaacacaaagcaagagaagatatttgtgatgtatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcagggaaatgcagattaaaactccagtgagctattgctacactcaccaggtggttaaaatttaaaaataattgatgttatcaaatgttggcaaggatacagagcaagaggaactcttattcactgcttgtgggagtgcaagttggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactattcaacctgaatattaattagtgtggcaaaagtgtaaagaatatgaaaagttaccaccataaaagtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggctgggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgcttgtgcccaggagtttgagaccagcctggtcaacacagtaagaccttatctctacgaaaaaataaaaataaaaaaattagccaggtgtggtggtgcatgcctgtagtcacagtttcttgggaggctgaggtgggaggatggcctgagctcaggaggcagaggctgcagtgaggcgagatcacaccactgcactttagcctgggtgacagagtgagaccctgtctcaaaaaaaaagcaaagcaaaaacaaaaaccaaaaaccaaaaaccaaaaaaaaaaacaaaaaaacaaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaacaaggatagggctgggataaaacatgttcccgattcctcctgcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacaggaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgcaggcagctgcctgtgacaagcgccatgaccctgccaggctcactccttggcggctcacagaccctgaaggcttggcagggcttgcctgctgccttctgccaactgcaggccactcaaccacgggatgctttcctgctgcttgttcctcgtcccttgggacacggaggcagccatccgagactcacatcagccccattgtccccagccctggggatgggaaactcttgcaggtaccagagcttacctgaggccatctcagacaaaagtaagcagagagtaaacagcagaaggtaggaagttctcatggcgactggcaggcaacacccaggatttcaggaactggggagacgctggctcctttggaggctgagctgacagaggcttccagaggctggagcgtcactgtatttataagactggtggattgcacaacctcgtcgacggaactgaagggaggtgccacagtcaagggtgaacttctaatcgctaacccctggtgtcatttgccctgagcagtcagcagtcacatggcacattgtctccatctggctgccgctggatttagctttcagcctggagccctggtgccagctcctcctgtttggttttctaggttaggcagttctgatggggtttctggaacaggcagttcacactggagtccctccttctggatcacatggaggagagccacagggaagctctgagcagggggccgctcggctctaagctggtgttggcctctttagtttgattgtcttcctgcaagacaaactcaaacttcaccctcttcccttgcagaaggagagctggttgtaatgaagtttcttcctctggccaaggctaccttctcatctctccccttatgcagaacactctcctcgatggaccaacttttctcttttcccactagacgtgttcctgggacgtttccaaagggcactcctcagaaagtgagcccccagtgtggcccttggagggtgagggtctgggccagcttgggcccaccctgcagagctacaactgccagattggggtgctgttagcgactctccaagtatccctcaggttttccttgattctaaagatttaagaaacattttatttattactgattttcattgtaattctgtgagcagctttcctgatgtctcagtggcttatttgcaagcagcagacgctggctctcgctgaccaaggaagggaagagtttattcggaggatatcagggttggtggggggtggtggcattgctggagaacccagcttgaggctcagtttccaggaatgacatccaccctacactgtcacggtggtccaatgagaaccccatactgcagccacatggcatgagacacccagagtggagtgaccctcagccactctaccgctggcagaatgccattctgcacccaaacatgaacctgccgtatactcccacttcaaccctgccagagaaagacagagagagatccagaaagatggacaaacaaaaacagagacagaggaagagacagagacatgcagagagacagtagagagacacagagaaacagagagatagaaacagacagagagagatggaaatagagagagagagagagatagagagaaatagattcagagagacagaaagaaggagacagaaagatgcagtgggatcctgtagctagctcattgaggcagttcacaaagggtgtttgggagaaaacttggaagaggctgagccatgcctgacctaggagcagtgagattgtggaaagagaaaagaaagaaccgaaacacagctttccttgctggtgctgggtaagacatggctcagcctcttccaagttcctcccaaacaccgtctgtgaactgcctcaatgagctagctacagtattctatcggatctgtttctgtccctttccttctgtcttattgaagccacactatgattctttgaccaggcaatataatcctcatgttagagaagaaaaacactggggttcagagaattgaaacaaattgcccaaggtcaccctgctggtaaatggaaaactggtgtaatggcctggaaagcctcattccctagcctctgtgctgaccgcctcctggggaggcttccaggttattacaccaggtgtgggttcaataagattgtgaaagaaaaatatctcaggcaccttcaagctgggaactgcttattgcgaatctgcctctttttctattcaagtcatctttttgctcccagagatacatgcgtatttcgattaacttttttggaaagacttataataaattcaaaagaatgcaaccggtcagggcgcagtggctcacgtctgtaatcctaacactctgggaggccgaggcgggcagatcgcctgaggttaggagttcgagaccagcctggccaacatggtgaagccccgtccttactaaaaatacaaaaattagctgggtgtggtggcacacacctgtaatcccacctactcaaaaggcggaggccggagaattgcttgaaaccaggacacattggttgtagtgagccgagatcgcaccactgcacttcaacctgggtgacaaaaccgcactccgtctcaaaaatacaataaaaagaatgcaactgtctgtctctcacatacctgtgacctggaagcccccagtggtgggggccttgctttgagctgtctctgcctttctggacagaactattgtacttcttatacattgattgatgtctcatgtctccctaaaatgtataaaagcaagctgtgccttgaccacctggagcacatgttgttaggatttcctgaggctatgtcagaggtacatcctcaaccttggcaaaataaactttttaaattaaatgagacctgtctcaaattttgggggtttacaagataataaagtaaaaaatctcagaatgctgccgggcaccatgtgaggtccgatggtgtctgtagatcctgggagtgaaaggaatctaaaccctggaatcctgattttcaggactgatgttttctgctctgaacctggaaaactttttttctaaattttatttttattttttatttattttatttatttttttattatacttgaagttctagggtacatgtgcacaacgtacaggtttgttacatatttatacatgtgctgtgttggtttgctgcacccattagctcatcatttacattaggtatttctcctaatgctatctgtctcccctccccctaccccacaacaggccccggtgtgtgatgttacccaccctatgtccatgtgttctcattgttcaattcacacctatgagtgagaacatgcggtgtttggttttttgtccttgtgatagtttgctcagaatggtggtttccagcttcatccatgttgctgcaaaggacatgagctcatcctttttcatggctgcatagtagtccatggtgtatatgtgtcacatttttcttaatccagtctatcattgatggacatttgggttggttccaagtctttgcaattgtgaaagtgctgcagtaacatacgtgtgcatgtgtctttatagcagcatgatttatagtcctttgggtatatacccagtaatgggatggctgggtcaaatggcatttctagttctagatccctgaggaatcgccacaccgacttccacaatggttgaactagtttacagtcccaccaacagtgtaaaagtgttcctatttcctcacatcctctccagcacctgctgtttcctgactttttaatgatcgccattctaactggtgggagatggtatctcattgtggttttgatttgcattcctctgatggccagggatgatgagcattttttcatgtgtctcttggctgcatacatgtcttcttttgagaagaaacactttgctttttaaggttacattttcaggatttcaagcatcctgtgagggtgctagaagaaggtcattttagtcccagtgtccagggcatcaccctgttccgctcacgtccatcaacagggtgatgctggagagcagagctcactcctgggcgctcttgaggagtgaggcgtggtagccagctcggaaggcatgggagcccgggcgagatgataaggaggccaggtcctgtgccatgtgcccaggagaaaccacatacaagcagaatgcagcatctactttcacataaatattgcagtgagactggccagagtcctggcttcatcactcacaattgaccaaagtgtggcctttgtgggtgggcgctgactaaggagactgatgggggctgtggtggcagaaagtgcacaagcctttgacagcccagggatgaggctactgacccacctgtgatgaatgacagtctaatggaggaaatgacacccgggatgaggttgtagagcagatgggggccaagtagatgaaagtgtggtgggaggaccacggacatctcaggagagcagggaccaaggcctatataggagatgcatgcgtgtgtgtgtggtgcattaaggcttatgtgtggtttgcatttaggctcatatctttgtgtgcgtgtggtgcacatttaggcttttccgtgtgtgcatttaggcttgtgtgtgtgtctgcctgtatttgggattgtgtgtttgtgtgtgtgcatttagatttgtgtgtgtgcatttaggcgtgtgtgtgtgcatgtacgtgcatttaggcttgtgtgtgcgtgtatttaggcttttgtgtgtttgcattttggcttgtgtgtttgtgtgtgtgtccatttaggcttttgtgtgtgtgcatttagatttgtgtgtgtgtgcattttggcttgtgtgtgtgtacgtgcatttaggcttgcgtgtgtgtgtgtatgtgtgcattttggcttgcgtgtttgtgtgtgtatttacgctgtggtgtgtgcgtgcatttaggcttgtgtgtgtgtggagggtgcacatttaggcttctgagtgtcttattgagcagctttggttttcttcttaggcaatagggagactttggaagaggaattacatgagcctgttgccattatagaactagtctaatatggaggtgtcgaggatgcatggagagggcgtcagcttggacttgggaagacccaggaaggggctgaggagccattagggtctcacacaatatggggaagggggaagaaatgagacaggaacttgagaggaattaagaagctaaagttaaccaccctccactggcagatggaaggagctggatttctggtcctggatggaaggagctggatttctgaccctggatggaaggcgctggatttctgaccctggatggaaggcgctggatttctggccctggatggaaggagctggatttctggtcctggatggaaggagctggatttctgaccctggatggaaggcgctggatttctgaccctggatggaaggcgctggatttctgaccctggatggaaggagctggatttctggccctggatggaaggagctggatttttggccctggcttgactgagtgtggtgtcaggccctgagctgggtgaggggaggaagagccggtatgggaagatgttgagttatgtagacaagtgagtgtaaggggtgccctcattcgccatcacagtggctgatgtgtcctctgcatgctggtctctccctccagtcatcagtgaaggctgacggaggggaggggctgcgtgggatttccacagtctcccctcactggagggtccagggtctggcatagataatcagtcactgttttggaataaatgaataaacagaagagtgttgctatggacggaacacattccctgcttgcataaatatataaaaggatatttaaggaggtaattaggctaaattaggtcataggactggtggcctaatagttagacgaagagaaatcagagctctgggacatggcgagaaggcgtgacgcacaaaccaagaagcgtccctcccgggaaccgaatcagccttcatcttcatcttgagcttccagcctccagaaccatgagaaataaacttgcatttacccagcctgtggcacattgttgtggcagctggttagacttatacaagtgttgtctgtattcttggtgaactcttcatttcttctaggacaacaaaactccggggactccattcctggcagcaccccaacctcctgttaccctcacccctatgggggcttcctcttcagggaggaacttcaggtttttaagacatggatgctttgttttggcttgagactttgcaagtcccataagtggtgagcacaacttggaacactattgcttattcccttatccgcaatagtttgtttgtttttttttttttgacagagtctcactctgttaccgaagttggagtgcaccggtgcaatctcggctcactgcaagctctgcctcctgggttctgggcattcttctgcctcagcctcccgagtagccgggactacaggcaactgccactatgcctggctaattttttgtatttttaatagagatgggatttcaccatgttagccaggatggggttgatctcctgacctcgtgatctgcctgcctcggcctcccaaagtgctgggattacaggtgtgagccaccccgcctggccttttttttttttttcttttttttcaagacagactctcacacagtgtcgcctaggctggagtacagtggcgtggtctcgactcactgcaacctctgcctcccgggttcaagcaattctcatgcctcagccccccccaagaagctgggattccaggcgtgagccactgcacctggccactcgcagtagatcttgattatgatctgctaaaggcacgtccttgactgctgaccttacaggccacgccactggcagctgcccagagcaggagctgtttgtgtcaggtgcttgtcacagctctggagcatgagacctgagtgtgaagaggggagggggtctggggtgggacagaagctgtgtagggcagtacctgccctggggctccacctgcaaggtcaacaggacacagtccttacatggtggggttgagctggtttcagtcccaactcaggagctcctcagagagtcagttccacccacgtaggttggagctagctcctcaatgccactgtgaaggaaaacgaaggacacagcctcaccaagcaccaccccagccaggtgtgacgccactgtgaatgtgtctagtcctcaggaccacgagaggctgtgtttgaagggagctgggccagcccctgagtcagacaggatggattcagcttctgtgcctctgtggagaggcagggccagctgggcctggcactcacctgtcctgctgctagtagcagtggtaaactgtctaacaccagaggattacgtgggtttaacacatttatgcgcacagatgaggagtgttcaattagtgctggttcttaccatgattatttctattctttcccatattatgaggtcatcattaccccatttcctagatcatacacctagactggcagagagtaatgtacaggtaatgagtggtacatccagaactgacccaagccatcagcatagggggttgagtgtcatcctctcttttgcaggcaggacatcccagtgctaaggagagtgacctcagacaccagagacacagcaagtgcagcagagctgacggctctgggaacactggtcttcaaagtcttccccgttgttggttttgttgtctttatttacaaataaagtaaatatttcttatttatagataacattttatttataaaaataatatacgtgttgcaaaaagttaaaacaatactgatgtgtagcagcagaaaaggaaagttgtcttgaatcctatttctcatggataaacagattgctaacaattgggtttctctcagttaatgacattctcttctacacacataaaggtatctattcatgtacacttcaatacttacagattgtaaaaaggaaacactttgtaatgctgatctgcagcttgcttgttttcctttccacctagtagttgtacgtctttcaatattttagatcaaatccatttttatagtgcatgcattttcagttgatccttgaacaactcggggctgaactgtacagctccatttacacatggattttcttccacctctgccacccctgagacagcaagaccaacctctcctctactcctcctcctcaacccactcaatgtgaagatgatgaggatgcagacctttgtgattatcctcttccacttaatgaagagtaaatatattttatctttcttatgttttctttaataacttttgtctctagcttagtttattgtaagaatacagtatataagacatataacatagaaaaagtatgttaattaatattttgttttattgataaggcttctggttagcagtaggctattagtagttaagtttttggggagttgaaagttatatgtgagtttttgactgtgcctcatgtataacttttcatgtacttattacccagtgtgatctactgatacaatgcaatccctatcaaaatctcaatgatttttttggcagaaatagaaagtccatcttaaaatttatagaaaatgccaaggaactctaaatagccaaaacaatcttgaaaaagaatgaagttggaggactcaaacttcctgactttaaaactcattacaaaggaacaataatcaaaacagcttggtactggcataaagacagacatataaatagtgggatagaatagaaagcccaacagtaaatttttgcatatgtgttcaaatgatttccagcaagggtgccactccactgaaagggagaaaagacaatctttccaataaatggtgctgggaaaattggatacccacatgcaaaagaatgaagttggacccttagctaacagcatatacaaaaattaactcaaaatggatcaaagacctaaacacaaaaactacaactacaaaactcttagaagaaaatataggcgaaatagttcactataatagatttggcaatgatttcttggatatgacaccaaacacacagacaataaaagagcaaatagataaattgatcttcatcaaaatttaaaaaatatttttatgcatcaacatacattataaatggaataaaaatgcaagtcatagaatggtagcaaatatttgcagattttatgtctgacaatatttttatgtccagatatataaagagcttctaaaactcaacaacaaacaacccaacatgatttaaaaatgggcaaaatagacatttgtccaaagaagatatacagatgctcagtagaatactttttaaccacattcctataaatggacattagattgtttctattttttttactactataagagtggtgcagtaatcactgttataataccaaatgtatgtatatacatgtatttacttgttataattactcatctaaattattactcatgtaacaaatatatactaagaacctgtaaatgcttggtccctgctttaaaggaggaggactagtgagcctatttaattattttgatgataaatattatgaagaaaaagcacagggaaccatgaggatgaataacttgacttgggcaactcaccggtgggttttcctgaggtaggtaatatggggtttactgcattaattcttaggcttggaattgttggctgaaaggttaaaggggtttcatctttaaaattttaatacatattgccaatttgtcctccacaaggtttactaatttacaatcacatgcaaaaaaaaaaaaaaaagtatagacttgcacctgtttccaatattaccattcatactggcctgggtttatccattcatttataaattatgaactttcttggatactgactacatgccaggcaccatgccagggtgaattagagacatagttccttgtcttgacaacttcactgtgggctggggagagacagacaataaatacgacaataaatacattactttaaatgacttagttatgtttccacacccagctgaaatgggcccgggagaatcactgtgtttcttgttgtcgatctgggatgaaattagggcagctgggttaaaaacatagttgaaagcagtggttttcaagcaggggtgattttgccactcaggggactttggtgatgtctggagacacttttgctgctgcagcttaggagggagcactatgagcatctggtcactagaggtcaggggtgctgctgaacatcctgcaaggcacagggtggcctcctatgataaagaattatcgagccccaaatgttaattgtgccaaggttgagagaccctggcaaaagaaagaaccagacaaggcagggttcaaatcctaggctagccactgtaaaggcatctcagcggtcgtcaacatgcttgtcttttgcataggggacgagattagatgttgtgattattagatgagaaaaatgaattgaactgtggagcacaggacacagcagaagttgtccatgaatggtgggtcatagtataatgatgacacaccacagtggaagaaggatgggagatggatatttcttaatgtgtagctctgggaccactttagaggaagcatggtaggagcaggaggagctgtggggcttggtgacttagggaaggatggatccgtgcctctcgttgtttctctgctatcttgtttgcgttgcattttcttggtcagttctgtttgtcatttttgaacagtttcttggatcatttaaaaaattgttttgcagctttttttttatcctttgaaatcagtgctgttgtttctcatgcatgttaccagtgtttcccccactttatcattcaacctgattcattatgtttcttctttgttctgcaggatagaattgctcagtgtaataacaatgtttcaatgtcttctattttgaatataatcacaatgtccactcctttgagtaaaaaatgataggtccggtgatggccattggcccaaatggtggccttactgagctacacagctccaaagggagccagcagtagaatcctggctttctgggccacatttgggccaccgtggagatagatgagtgtgtgatgtcagtgtaccttacagaggtgatgcaagtagctcagactcacactgtgaatccacagtgcttggtgctttcaaagggtttcaaaggatttcttgagaagcaaattctatttgcagataatttctatttcagttcctttctgaaatatgaaggcaaaatgttaaaaaagtgacattgatattataactcataattcgcataacaacctttttgttggccgggttggagacgttacacacactttgaagaaacacaaagccagtagtaattctacaattcagaaaaagctttatctggcagcatctttttgttctacatccaaatcccattgtgatatctaatagaaaaagccttagaggtggcaaagaggtggatggatggtcttaatgtccaccctagctccccagcgatcctcctaggatgtgttgcaatgcgtctaatattctttccagaaccgagtgttgaatggtgttccccactgcaatagaaacacacttggaataggatagcatttatagtcatgaccaacctgtaccccgcagggagttgcaagctgtgctctggcagatggaaccgaaaacacacctctgccagggaagctttgagccaagcgaggaaatcaaattcttcctgttgtgcccagaattgtgatttactgcccatccgaatcatagcctcataatatctcagctggaaggacgtagccagtgtctactccagggagtttctgggagtccctgggacttagagttctgccagtaccaacaaggctgcgctcgacaccttagcccacttcctagccatagccatttcttccacaggccaggacttctgaatggcttttgtgtgacagacagtttctggcagttaataaaaggaaaggtagaactaatctagctcaacatcatcagataatttacagatatagaagataattgcagagtgtaaagagatttgttcaaagtgacagcgtgaaagctaaaaaagggacaatcagaggcttccctgagcctctgaagtgaggtgactgtacctgcatctgtcccagcaccgggcccagccaatcccacttggctggggtgggtggtgctgcctgagagtccgggcagtcccttttcacccctgagcctgaccctggtttctcagaatctcagaatctagctattttgaaatatacaatacatcatggtcaactataatcaccctactgggcagtagagcaccagaacgttttcttcctgtttaatggtaactttgtgcccattgaccaacccctccccatcccccctccccctcccctccccatcccccctccccgtcccctccccagtctcaggtaaggctattctcctctctgcttttgtgagatccactttttggtttctgcatatgagtgagatcaggtggtatttgtctctctgtgtctggcttactgatgattacacaaggtgtacatatgtcagtatcacagtgtaactcatacatatgtacaattattatgtgtcaattaaaaataaagcaaagaaaaataaaaacaaacaaaaaaaatctgagcatacatagggctcttcaaggtccttaacttttggggacttctttttgtttcacaccaaaaggaatcatggttgtcctctgccaaatgccagccaggttgtttcatactgttttaaccttgttgaaaacaaaggcaattggaagcatttcagcaactcaagagatcatgtgtttatgtgatttattgtgagtgtggagtaaaagggttactagacgctaaaggaagtaaaaccaattttgtgtgtgcaactatcagctcccatctgaaatccccccagacagcttcctgctgtaaccagctttttcctgtgagtggtttgttcattggctttgcagaaatgagaacagccaatgatgtcaggagtccggatttgccgaagtcatcagcatctggcaaagcctgagctggagccagaaggaggcgccatggcctggtgggaagccccgatgaagagtgggaggtgaagctggagtcagggttttgtggaaccgcctgtgcccgatctgtgagaagctatgggttatcagccacccccggtttcctcccttttaaaagaagagggtgaattttatgtctttttagggaccaattttcaaactaggcagctcatcagaatcacctggtgattcttcacccaaaaaaaaaatcaccctcgaatcagaatttttgataatgaggctctaggatctgtctttttaacaaaccccccaaatggccacaactcacacaatgttactgcttcatgcttttacacatcttgatgtatttctaggatttgtgaatgtatgctttttcaattttagcattttgaagttaaggtgaatcttataattgatgtaaataattaatgtggtcttctctccccttcccccgattctccttgagaagtggataatgaattgtgaatcttatatgcggcggtatttttaagtgaaggaaacacctcctctcatttccaactttacaacaactacgtgaagtaggttgtgcaagaattatttatcccctcttcccagaagaagaaacgggcttgaataggttaggcacattaccctttgatttatttattcaacccacgttaataataagcatcttctgtatgtaggggctgggctagattgggagaaagcagagatgaagacctggctcctgtccccaaggagcttgcaggcttgtgggggcatcagagcaataattcgtgcccgtggctagatcaatattggctctagaagtctcctctgggaggtgaggggaagagcgactggttctcatggggcttaggaaaggcaccgttggagaagtggcatttagagggagcttgaagaatgggtagggcatgctggacactgttatagtgctatcctcggagactgcaaagccaaggaatcaaaccgtagacacacagcaggattctggtggtggaaacacatgttggcatccttgctctctcaatgtgacttggggcaatttgtgaccatctctcctctgaagaacggagggctgttgttggagttaggtgagacgatgttggccaagagcttgcatagtgtcgacacttcagcaacacaggaagtggggtaggacccaggtgtgatgggtaattttctttatcaacctgactgggctgtgttcagaaagctggtaacacactcattctgggtgtgtctgacggtgattgggagagctgttagcatttgaatctgtagtaaagaaaatgtgcactcaccagcatgggcggcattgtgcaatttcttgggggaggaatagaacaaagaggcaaactcgctctcttttcttgagctggaacatccatcctttcctgccctgggacattggaacttctagttcaggcgctttaagactccgatcaggattttctccgtagactgccctggtgctcaggccctcgggtttggactgcacgacatctgcagctttcctgggcctctggcttgcagatggcagatagtgggactgctcagcctccgtcatcacatgagccagtccctcctaataagcatctttctatctatttatgaatgtgcttttggttctttttctctggagaaccctgactaatgcaccaggataggaatgattcggaaggagggaagaggcttagggccctgccctgctgggttctgttgcaagtggagggcaggctgaaggggagctggctttgtgataattcatggggttgaacacttggtaggctcttcggcgtgaagagatcagacccatcctgcactcctgccctcagcccacttttgctcttttgtccactgtcactgagggacttggcggcgtcagagccacagagagggaaggcttggactcaggaaaacagtgagcatgccacctcttctgtcatccaacagtaggcctggaaggacttttatcaatgctgtgcctggcactacacacacacacacacacacacacacacacacacacacacacacaaacacacacggatgagacagagatgggtctcattctcagcacggcatacaagtgttaaataattttgcaggtgttaaatctcttgcaggcgcagcacacggactagtattcatgtgaatccagggtcgtgacatcgtttgggtgtgagggaagtcctttcagagcttggggtgttgaagttgagatttgaaagatgagcagaagctgttcaggcaaaaggagtggtgcagggagagaggggctatgagcactctaggcagaggacatagaccctcagaggccatccatgttaggaaccagcaaagtgcattgcagctggccctgaaaaacggggagaggaggacagcaggctcaggggcttggccaccatgcctggggaaccctgccaaggatggggaacttttcttttcttttttttttttgagacatagtctttctctgttacccaggcttgagtgcagtggcctgatcatggctcactgcagccttgacctcccaagctcaagagatttccaggccccaccttagtctcctgagaagctaggactacaggcaggtgccaccactcctggctaattttttgtttctttttctgtgtgtgggcagatggggttttaccatgttgcccagactggttttgaactcctgggctcaagagatctgcctgcgcagcctcccagaggctgggattacaggcatgagccactatgcctggcaatgtggaacttttctacaaggacaagaggaaaccgttgaacagtttcttttctttttaaatattgtggcaaaatacacataactcaaaatttaccattttaacaatgtttaagtgtgtagtccagtggcattaagtaaactcacgttgttgttcagtcatcaccatccatctccagaacttttttatcttgtaaaactgaaactccatacccattaagcagtaactcccactttcctctcgcccagcccctggtaaacccagctatactttccatctctgtgaatttaactagtgtaggtgccttgtctgaatggaatcgcacggtatttgtccttttgtgtctggcttctttcactgagcacaatgtcctcaaggctcatccatgtagcatgtgtgagaatttcctttcttctaaggctgaatactatttcattgcctgtgtatactacattttgtttatccagtcattcgtttggacacctatcaaaagattttaagagagtaacatggtccgatttacattttggaaacatcagcctcgttgctttgtggaggctgatttggaagaagatgtgagtggctgcagggagcccagttaggaggctgccagatgagtccagtataagaggctgggtggcggtgaggatggtagaaatggaaggtttaagagctattaatacttagaaggaggaatgaaaagtttatttgggtgtaggaagtggaggagaaagaggactcaagagtcatttcaggtggatggggctgttatttacaagggcaagctgcagacaatgagttgggctttgggtttgtggagtttgagaagtgcatgggccattcaggcagggatatatgcttctaagctcgaggctcatttgggaaagtactggcctagagaggcaatcagtgccaaaggggtgcgtgaaactcctctctgcagaatgaaaagcagaaaaggccaaggagacattccttagtaactccaacatctgaggtctagtagagttggattggccaaccaacaacagtacaaggggttgttctgagagcaccaaaccagaggagtgtggtgtcatgagagccaagggaagataagggcttttaggaagaaagtgtttggtgagagagactgaaagagcgctcactggtttcagcaacacagaggtaactggtagcattggtgaaggcaatggcatattgagaagctgcagaagctgagacattcgatggttaccagctgtgtgttcttggtgtagttgttcaatttctctgagccattaattcctaatctgcaaaatgatacacccaataactcatagcacctgtgcatttaggggttggaggtagatagaatatggcttccagagtcaaggcaaggtctatctgtacaaggtgatcttcttgactttgtggttgactccctggactctctgttctatgcaagccggcaacaaaggggttttgcagcgttggtcaatgttgtcttcaacatttgcactcaggacttttaatggatgggggattaggatgagcaagaacaaccaggcttttctgctgcaggaaacatcccaggtgcatttactcactctctggtgttttatttctgagaagccagcagcaagagagaggatgctggggttgggaggcttggactctgggctcaatgctgtgggtgactggccatgcagccttggcaagccactgactcccacctttgaaattcctaacctatgacatggagccttcttcagctagataattctggaatgtacttcctcatttcaggtgtgtctgtattgcaaataagtccctaccaaaaaaagttgttgtattttggacaaaaagacacatctccaagccaggtacttgcatagctcttgtcacagttaattcccaaaacaactctgtgatgtgggtactgctaatcccatttaatacatgatgattgcttggcttcaggggctaatgacttgctcatgtgggagagagtgtttgtatcaggtagcaggaagttatgtttaggcaggggattattaattgaaaccgtaattgatcacttgctcttttgcaaaaggaatctgttgtgtcagccaatgcctggaagaacccagacactcattcctgtcctgagagtaaatctaagatcctcagctgacgcttggagacctctgttctttggctccaatcacattttgctggtttagtgtccacttttctcttgcacttccacttacacctatgctttggttttactgctccctccaagtcctacatcttctgccttgatagctttgggcaggtgactcccttggcctgggacaccctttcttggtgacacagtttggaattctgtcgttgtgtcaaggccagtgaacctttcctgacctcccaatgctgtagcattttcctccttttgaatctgcactgtattttttactttcctcctagtgtctctgccttgaatcagagttatttgcctctttattgcctttatattagaacatgaaggtgatttagtctttgaatttcatacaaaggaaacccatgacaacagttggcacgtaatgaaagctcagtgggtatttgttgatttcagatgcatgcatccttaactggttttggctcacttatgcactcattgattgaacagctaattattagggtctaagataatgaatatgatgttccatcacctttagcttggagaaaacatcccatgaaatggccacacatttcttctgggatgccccccgttagccgtctcggctggggcttcctgtcctggcatgttcgcacagcatgtaagaggtcctgtgggacacacgctctcatatgatcactgcctcagcctgtgagactagtatagcagatccatcttccccaaggtcccattttctggaggtggaaactgatgttcaacagtgtggaccgacttgccttgtgtctcccagctactgggtctgtagatgctgagtcttctggcttctgttcctgtggtatttctgggagtcaaggaaggataggaagaaaaggtaaaggaacaagtagggaggtgaggaaaacacaccagagaacagtgtggagaaggaagaatccgactcctggggctcatggcctggcgtaagagcaggttgcttctggggctgccaccagtttacccatgtgaaggcagactttgctcctaagtcctggatctcactcactgcagggtggcttctgggcagcagaggccaatgagctgggcacagagaccaggtcggaggcaagtcttggcccagatcttcacaaaatcctgccctaactctacctatggacttcaaaattacaactgcgtttaaaagtgtcccaaaccaagcaagctttattgtttaacagtattgagagtagggtaattcaggatgtaatggaacagctgtcttatcaggaaaaagggggtgtactctctcccccaatttctccctcctacctctgtaaaccctcatttcctccttaccgcctaccaaccagcatagctgcttcccagcaaagcccgtggaaggccaggctgggtgctggattctgggtccctacatgcttagtaaatcatcatgcacctgccatgtgagccctggcttagagccaggctttctcatcaaagcaaactgcttgtgttgtgtccataagcggcaagcactgccagacactcccagccatctggaagagcaagctggatgctcccagcaaggcccaaccagaatcttcacggggtgccttcgtggccttggttcctcgtttattaagtatgagtgtggccctcatgagttctaaggtttttaccttcctcctttggaatctacgatccagaatgggatcagctccctccaggagagtttcatgcagcctggaaaccttcctcacctcctggcttgggttatgggactaggctgcaccctacagcatggcagacctgcagactcaggaggctaaaaccccggttacccactgtgaggaactgggtggtgttaggggagttacctaatgctctgtgcctcagtttccccatttgtgaggtggtgacaataaccagtatctactgcaaaatattgttgcaaggattaaatgttgttatgaaatcaggatagtgcctgtcacccagccagcgatggtgggccttactgtttttgctgtttttgtaggcacctggaggctcacactccttgaaggtgggcacttcatctcaatcatctttggattcctactccctgtacttgtgtgggccaccctgggctcccagcaatgtccctgagctggggtcgactgcccttccacctattctaggcctgctgtgtacccctggttgagtatttatcccatgctcagagcactggagctgctgtgaatcataggacttgttggataccaccctgggctaggatatctgtcattctcatcatacaacaaacatgtttatatatcaaatgcaaataccaggtgtagatattttcatttgtgtgatcgtggaatttgctaacattcatatattaaacagtgactccactagccagtgatgcagtgaaatgaaggcactggatggagcagttgcgctgctgcgtcttggagggataggatagcaagtgtgctgctgtggtgagacctccgtttcctcctggagatggcagctgagctaggccttcacctgggatgccaggtgttttggtgtcagggactgagggaatgctcttggtaggggttgctcaatgctttcaaattttcacaggttcccaggtttgtctctagacacacaaccagcagtttggtttctgtcatagagagaaaggacttgtgagccagtggtacccctggctgtactctacagccatgactccaaccctccccgaaaccatctccactgcaccttcccggtggtctgctcaggacactggagagatgacaggctttgaacaaaggctcaggtttccggcttgaaaacagccttgctggaaagcagcagcaccctcactggggcaagaaactccatgggcccaatctttccagttgtggcatcaccatcactcttgacttctgtaagcttttcttaagatctgaccctcacaaacagacaaataaaagcaaacatttatttcttgtgccatatacttttttctggtaatatacatatatatgtatgtatatgtatatatacacacatatatatgtatatatacacatatataacatatatcatatatgtgtatatgtacacatacacatacacacacacatatatgatatatatcacatatgttacatattatattacatgtatgtatatattatatattatatattatatatattatattatatattatatatattatattatatattatatatattatattatatattatatatattatattatatattatatatattatattatatattatatatattatattatatattatatatattatattatatatataatatatattatattatgtattatatgtattatatatgtatatttagaattggccagctttttagatgatctcaattttgttggcaacacccaaagcattgtaatcaggatccagtcaaacatatgccttcttctctccatcaggccgaatcagggagttgaccttggccacatccatgtcatagagcttcttcacagcctgtttgatctggtgcttgttggctttaacatccacaataaacagaagtgtgttgttgtcttctgtcttcttcacggccgactcagtggtcagcggcaactcgatgatagcatagtggtcaagcttgttctccaggagacgctctcccgaggatattttggcgcttgttctcccggtgggggggagctctctcgaggatatctgggctgcttgttctccagggggagctctctcgaggatatctgggtgcttgttcttcggggggcgctgtctcgaggatatttgggctgcctccggagtcgcagtgttatcggaaagtgggtgacgtgcggatcttcttttttttttgtggctgtggacgcctttcaacactaccttcttggccttcaaagccttcactttggcttccgcttcaggaggggcaggagcttccatctttgctttcggcgccatcttgtgaaaaggctacgttgttttttttttttaattatggaaaaatctatataacataaaattcaccattataaccatttttaagtgtgcagttctgtggcactaactatatttgtattgttatgcaaccaccaccactatccatctctagatattttaaaatctctcccagtggaaactctgtacccatgaaacaccaactctccatttccctggtaacccccattctactttccatctgtatgaattcagctactctaggtacctcatatgagtggaatcatacagtatttgtccttttgtgactggacttatttcacctagcgtaatgttttcaaggttcattcatggagtagcacgtgtcagaatttccttcctttctaaggctgaataatgttccattgcctgtggacgacccattctgttcatccattctgcagtccatggacacttgggttgcttccaccctctggccattgcgaataatgttgctgtagacatgaatgtacaaatatctgtttgtatctctgctttcacttgttttgggtatggatatggtttggctgtgtgtccccacccaaatctcatgttgaattgtaatcccctgtgttggggcagaaacctgctgggaggtgattggatcatgggggcggatttcccccatgctgttctcatgatagtgagtgagttctcacaatatccggttgtttaaaaatgcatggcctctcccttcttctgctctctcttgctcctgctctggcatgtgagatgtgcctgcttcccctttgccttctgccatgattgtaagttttctgaggcctccccagccatgcttcccgtacagcctgtggaacagtgagtcaattaaacctctttctttataaattacccagtctcagtctcaggtatttcttcatagcaatgtgagaatggactggatcatatagtaaatctatgtttaatttttaaggaaccaccatgatgttttccatagcagctgcaccattttatattctcacccatagtgtgcaagggttctgatttctctacatcctcatcaataaatgctataacatatagtttgcaggcatcatatttcattcttacaacaacccagcaaagcagaccgtaatgcccaaatatagacaggcagtttggagatattagtgaaatacaaaacaacctttccagggccagctaggaaaagagtgaagtcaggatccagacttggctttggattccaaagcccatgcccttcccagcctatcagactatatctctaatagatgaatgcattcttaattcacctaaaatgttagtataaattattaccttttaaactgggtacctgctcaatagagtattttgggcactgggttgtcaacaaatcatctctgcaccatggtgtgccttggttccgggagagcatattctaatgcataattagtagaaataatggagtctatcatagatttgctctgatctgagatggttagtaacagggcacacggtgcacagattcctttccttttactcatttggcaaacagtcacggagcctatcctctgtgccgggatgtgcatggggctgggattttagggattcaaaggtttggttcctgcctacgagccactgaagccacaggtggcagggacagtaaacaaggtctgcccacagccggatgagataaaagctggtggaggttaagtgaaagccatccctgctctacttttgaaggtaggaaccacagccaggtttcacaaataaaactgatgacagaacccatgtgtctcattgcgctggctgctgagaaattgcgcaaaccgtggcaacaatgagcttttgttttgtgaacccaaagtattagagacgggtctcaatcaatttggaaagtttattttgccaaggttaaagacttgcccgtgacacggcctcaggaggtcctgatgacatgtgcccaaggtggtcaggggacgccttgctttttaaacattttagggagatatgagacaaatcaatatgtgtaagctgtacattggtttggtctgtaaagttgggacaactcaaggcgggggcttccacgtcataggtagataggagcccaaagtttgcgttcttttgagtttttgctcagcctttcagtgaatatacaatatatatgtgagagtgggataggggaatagtcacttatgtcttagtctggctcagtgaatctgcattctccatcaacaaaagggcagaggaagcaatcagatgtgcatttgcctcaggtgagcagagggatgactttctgtcccacacctgggaaggtaagctatcagtttacactgtcagggtaaaattcagcagaactgttctaggggaaaaatcttgaggcccacaaggaatttccttgtgggaaaattgtgagggaggtgtgtagctttttaaatctttgcagctatcttatctaggaataaaatgggaggcaggtttgcctatcgcagttccctgcttgaattttccccttggcttagtgatttggtggtcccgagattgattttcctttcacaggttaaataaatatgccgtgcaatattcttaaatagatgaacaagattattagttgttgaaaatcagagtcttgaaattttttaatgcattcttttttgtttgagaccaagtctcactctgttgcccaggctggagtgcagtggcatgatcttggctcacggcaacttctgccctctggggtcaagcgattctggtgcctcagcctcctgagtagctgggactacaggcatgcgcccccacagctgattaatttttgcatttgtagtagagatggggtttcaccatgttggccaggctggtctcgaactcctgacctcaaatgatcagcctaccttggcctcccaaagtgctgggattacaggcgtgagccactgcgcctggccctttctagtgcatttgaatcagtctaaatatcaatgggttccttattagtttgcccatttattcatggatgttgattgactgcttgctgtgcatctgggagcctcctgtctcccagctggctgtgccctcagcagcaacactcttgtccctcccacgtgtgggcctgagtcagggttcactactgtggggaactcgtgagggatttggacagttttggtgaagtgcaggccaccattcttggagattggtggaggtttcttagccttctcggcaacaggcctcagccatgggtggggaggcttctgtgaccttggtctgcagcctggaggacgacacttcccctgcgcccgccctccctgtttcctggctccacttgcaggggctctgtcctgatgccaatcacatggagtcacaggacaagcaaggttccttccctcctagaacttctgttttactagaataggttaacccagtggaaaagacggacaacagacccataaactctgtgtgtgtgtgtgtgtgtgtgtaaaatatggtgtcaggcaggggaaagtgtgtaaaaaattaatcaggataagtggatgaagaggttagtttaagaggaggcagtctgagaaggcctctctagagagggagccaccaatattgtatacacgcacgcgcacagacacacacagccacacatacacacacacacacgtagacacactcacacatacagacgcacccacacatacagacacacacagacacacacacagacacataagcacacagacacacacacatacagacacagacacacatgcacagacacacatgcagacacacacacacaggcacacacagatacatagacacacacatgcacagacacacatacacacagatacacacagacacacagagacacacagacacacacgcacagacacacacacagacacacagagacacacacatacagacacacacatgcacatgctgacccacgggtgcacatacacacacaggctgagccggctggtatttcctctcttcccctgttttgcccagacacgcaggcatcacggtgtctgctggccacatcctccacccaaacgcaaaagctgggagaggagcctagagggtaggtaacaataaggtcaagggcagttgctgcctcagaggacacatcccagatgaggcacaggctgggaaggagcccaggggcagcagggacccagggggaagagaaaggacagggggaagagaaaggatgggggaagagaaaggacaggctggatgaagcccccccacgattctttctgacccagcatgccctccatccaccatccctcagccccagtcaccagcgtaggcgctccaaggactggtgtgaactgagggcatgagtgcagcctggggcacagagatgactgttctcactgcaagcctatcaagccctcctggcttccactctgtgctgcctgaaatgtctataaatggtgtctgtaagtctgtggcgtgtaaaggctgccttcctcctccctgatgtgcataagggcagagctgtaaggtgaattctagcccagtggcgtatgcgagctggacaggtagagtgcaagtacttgcctccctgagtctctgtctcatcctgggagatagggtgacagtggccttataggactgttgctgtggaggtcaaatgggctaaggcccagtgccttctgtgtggctaggctcatggctgtagcattgcaagaatcccaggctttagtgtctgcgactgtgaattccagcatggctaattattagacaagtaactgggagtatataaccaaagtgcccgggtcacattttctgtagctgcagaacaacacctgttttgcataagaccagatggcaaaatgtgggaaaatgctgcactgaatacaagtttgggttgactggctccaccgggcccaggcgtgtggcagttgtgatggaatccacttcacgtcttcctctgacagggtgtgtgtactcagcccaggagctggggagacctcatgttcatattagtttggtgcaaaagcaattgcggtttcagactgtgaattttaaaaaattataactaggctcaaatacatttttattagtcaaaataggaaccattacaatcaacacatttttgccaacaagaaataagtttgtttattcctgtagtgtaaaaatttgtgtttcaggatttgagtaactgttggaaagcatttttctgcatcctgctggttgcggaagtgtattccctgcaaaaagttgtccagatgcttgaagatgtagttggttggcaagaggttcaggtgaatatggtgcatgaggcaaaacgtcatagcccaattcgttcaagttttggagcatggatcgtgcaacttggggtcgggcattgtcgaggagagaattgggccctttctgttgaccagcgccagctacaggcattgctgtgttcgatgcatctcgcggatttgctgagcatacttctcagatgtaatggtttctcagggattcagaaagctataatggatcagacctgcgcagaccagaccaccaaacagtgactatgacctatttttggtgcgagtttggctttgggaaatgctttggagcttcttctcagtccagccactcagttggtctccaccgcttatcgtataaaatccacttttcatcgcatgtcacaatctgatcaagaaatggattgtcgttgttgtgcagaataagagaagatgacacttcaaaatgatgattttgttttttaaatttgtgtttggctcatgaggcacccacttattgagctttttcacctttccaatttgcttcagatgccgaatgaccgtagaatggtcgacgttgagttgtttggcaacttcttgggtagttgtaagaggatcagcctcgatgattgctctgaactggtcgtggtcaatttcccgtggccggccactacgcttctcatctgaacccccactgtactgtgtgttcattagcagttcctggaccaaatgcgttgttgatgttgcaagttgtctctgctgctttatgacgcattttgaactcaaataagaaaattgctcaaatttgctttttgtctaacatcatttccatagtccaaaataaatataaaataaatagcaagtaacaagccgttagccaaaaaaagtgagaaatgtgcattgaaatgtataatataaccacatttatttaggaagctattccaatgtcaattagcaaatttccacaatacaaaaactgcaattatgtttgcaccaactaatagaaagctttctatgcagatacatggaaaagtgggagctcctaaacagcagggaccaggccatatttcttatagttcttgcactctggccacttttcgcatagtagctgctcagtaaataagcacagaatgagtgtggctgtagttccatgttcagcttaacggtacaactaaagtaattcttgacccacagctgggttgagctatgcatgccgctggagcccactcactgtgtggtcctgttcgattccagtcatccacccacccatgagcacagaagagaggggtcctgtagaagtctaataccccttcttctcaggcctctgttatcacaacatcaccaattccctgcaaaccctcccagagcttgcaaaatgccaaatcccaaaggtgccatgaaaggatccatggcgccctggatccctggcagaatcttttccacggcaggatcttttaagggagtggtggagagggtgaacatttgacttcagttatctttttcagtgaagaagccactaaaagtgattctaccatgggagggacaccagtggaggagagaagtggggagcaccaggggccactaggattctgggtgctttgactgtattttctcatttaatttcagaaccccaaatctgaatagcaccatgtcaaaataactaaagagataaatttcatgagagctagaaataatattgtcatgacggttattatttaaatatttttggtacaatttgggattttttttctaaattctcatggcacatctgagaggtctcacagagcaccagtgtttcaaggaataggaagacatgaccaagagtgcaactcgtggatggctgagttcttgcttctgcctctggaacaatgtttggtcaggtcaaaacaatttcttaaggtgcttacaaatcttgacagcaaaaacatccattttttaaaaattttttaaaaagaatggaaatctgagaagtaatcaaattcaaagaaaaaatgttattttgacgctcacaaactgttggcagttcggcaatactataacatgtacacacccttattattatttttgaaaaatgagataattaaaagtattttatgtatgtttgttttatgttataaacttgaaatatttttaaattgcttataaacatacataaaatacatattaaatataatggttgtagttaaacacaggtttctgtggccactatatctatattatatggaaacttcaacttcatctctccctaccaaaaagacttctgggaacttgaaatgtagtttaaaaaccactttgtttttcttttctttttcttttttttgttagacggagtcttgctctgtcaccaggccagagtgcagccgcatgatctcggctcactgcaacctctgcctccccagttcaagtgattctcctgcctcagcctcccaaggagctgagactacaggcgcctgccaccacttgggctctgctaatttttgtatttttagtagagatggggtttcaccatgttggccaggatggtgttgatctcttgacctcatgaaccacccgcctcagcctcctgaagtgctgggattacaggcacacgccactatgcccaggtaattttttttgtatttttagtagagatggggtttcaccatgttggccagactggtctcgaactcctgacctcaggtgatctgcccccctcgtcctcccaaagtgctgggattataagcgtgagctactgtgcctggcctaaaagccactttcttagccaacctctttaacaaaactaatttgcaagaaacagaatctggaaacttagcgtttggttattattcattgtaccactcaaccaaagctttacaaattttgactttggcatatgacttcaaaatttttagaaagacacactctagctagaattcccaactatctcctctgtctatccttccatttgagcaaacattttatgcagctctctgtggtggactccaactttcagagactcagaaacacggctgcctgtgcaatgctgatatcatagagcaatagaagcagcgccatgaaagaggtcctctcctctacctgatcattttgcagaggaggcccagagagggggagggacggcattaattcattcctttattcattcatttggcatttattgagcaagtgtgctgcaagtatgccattagggtgtggaattacaaccataaataaaatactgtttcgaccatttcagaacatagtttagttgaggaaaaagacacaccaacaaccaaagcatgatgagttatcataggagcacctttccttcaggaaacagctgttggtcgtttgttgtatgccaggttctgtgctaggctcggagaatataggggataagtcagagaggtccctggtcctgatggaatttaaacacacatcaggaagtagatttgaacaagatcatgagaaatgttgagtggctggttgtggcagctcatgcctctaatcccagcactttggaaggccaaggcaggaggattgcttgagcccaggagttcgagaccagcctgggcagcatagcaagaccctgtctcaaaaagaaaagttaacaaataaataaaaaggaaatagcgttcagcaaaaatgttgcaggtcctcaccacgttcttcacaggcacacgtcggggagagaagagagggcatcagaggttgcagacttaccaacagccgtggtggagcccgttggctccctggaactctcgggactgcatggtgtggctcagcataggtggcctgcgaggatcttggtaggcagtccacagagagaggccttgtcctccgtagtgatcactatttcagggatggactagaggttaggtcaaggaacaactaaatgtcatagagagtgatgctccctgctcagagaagtggctctcttagaaaggggacatctcggtggcagggactggcacaccctgatctgccaccgagctgactcaggtgtgcagggccggccctctctaagctgcataatggggaggaaatgggcccccacgtctctgcatttgcctttccttcaatactgaaggccatgtgcatagggctgtgtgattatttcagcagcgcttggctgggtaaaggtggcagaataaacggaacagacaggatgatccagacctaggtccgcctagacgcatgcatgtggcacaacgtgtgacggagccacttcacagctgcctttttgataagccatttacaggacttcaggatgcttcttgaggacaatgggatgtcatcgaaggtattgagaacgatgtgaagaaatcgttttcatttttctttttttttctagagacaaggtcttgctctgttgcccatactggtatgcagtggcacagtcatagctcactgcagtctagacctctctagttggagcaatactcctacctcagcctcctgagcaggtgggcctccaggcttgtgccaccacacccagccatttttttcttttttttgagacagaatcttgctgtgtcacccaggctgcagtgcagtggtgcaatcacagcacactccagtcttgacctcccacctcagcccctagagtagctgggactatatccagctgtttgtttatttttttgttgagatgaggtctcactctgttgcgcaggctggtcttgaactcttgaactcaagtgatcctcccaccttagcctcccaaagtgctgggattataggcatgagacactgcacctggtctaattccttttcattttaaaaagatgtggaggaagtagattggaacgagggcaaggaagatccaatgagacaagctgagtggctgttgtaatgatctaggttgctggagatttttaaaaatgtattttgttcactgttttattcccagaacctagaagagtgcttgtttccaaatagacacccagtaatagttaatcaacaaaattcagttgctggtttgagggtcagtggaacgtgggtcccttttactgacacgtggaattgctgatcaaatctcctcttagcattattatttccagtgactctggagagggagggcccttttccaggctttagggccaactgacagagaaaaatgaaaacccaggtaccacaaggctgaaaggtgaagacggagtcatctcaaattcttcccaaccagctcatcaagatctgctggttgatataaatgtgttacctggaaggatgacttcatgtgtttgttttctgttttgaagaaaggaagtgtatttggcaagggaacttcttcctttgttcagctctgggaatccttaaagtcaacagatttccagcaggttatactcaaacaaggttgtgtctcatggcaaacaaggccttagaaacagacaggcccagttttgaacaccagctcaaccattctcaagacatgcgatcatgggcaattaacctatttaatatccatgactcagctttttccatctataaaatgaaataatcctggtgcctatatcatagaattgttctgaaaaataaatgagataatatgtgtagtgcattaattaaaacatggaagcaataagcacttgctggatgtcaggggtcattacttccactacagttaaagtggaaaatggaaagaggcctgctggagccagatgtcccctggcggacgctctggtctggggacaggcgacacacctgagtggcctattgccttgtgctgatggcttagcctggtatgtctgctgatcacgagccaggaggagtgggaactgagccatagccacgttggaggaaaatccaggagcaaactccatgagagagtcatgaaatctggcagtggaagggctgccgcctggaagctagtgcttggtatatctgcatgagaaattaagggatcaggatgggaatgtctttacgttaagccttttctgcttgaggtgactgcatatgacaggggacccagagtgacagcataagctgtggtctccctgcagacttacatgtgtcgtggagtctgcgtaggtggcagagagcttgagttgctccacggccaaagaacccatgctcagttaagagaatgtgaagaccacacgcttgggccaaccatgctgggccggtgttggatttgcaggcaggttctgaacacagagtgtcagccgctacttagattgttctttttcacatggggtcgccagtctgaatgcctccctgatgggatccgtgctaaaaccctaggcaggggaagtgtaagttcccaaatgaaaagggtgagtcactgaagtagggtcagagggaggaggcagctcctggggtaaaacctgcatcagaggtaaaagggaagagcctcttagcagggagccggctggccttgctgcctgggcagatgcatcttttactttcttatatgtttatcagtccaggaaaatgtaagcccagcgcattcagggggcttaacgcctttgttttcctgctgtgtccccagcttggagaaacaggcctagcacagcagagatgctcaagacatatttgttgaagaaatgaatgaatgaatgaatggatgcagattcacttacgcagcaatcccctgtcaggtgagaaggtagagagtgctgctctaatcacttctctctttacctctctgccttaccaaattcctcctatcttatgaggtttagtaaaaatatcaccattaccagctgttttattttcccctaaaatggctttttatctgttgttgacatgtacctcggccctggatggtttatggttttgccttattttgcctttgttcggtttggtatgaatttgatatgagattgtaagttttttgagggagaggccatgccttagaatcacagacctctccagtcacagcgtcccgaggaaaggaactgaggctcagagaagcaaagccacacaaacactacacagccctttgtgtgttaaagtggctccaccatttctttctggggagacttgtgaccttgtccataaatgcattcttagcactcctccaaatggtagtgtgctggccttctgtggagggatgtggcctcctaagatgcctcaactttctccagaggatgacagcctttcacaaaagcacgtcatttccagttgaactgtggtaaaaagaaaccaggcggcatttcaatgagaacatagagcgtctgtatcccaggcatctgctgggatgttcctgtcaatgccctccccacagcacttaccacagttgcagcaggagacacgttctgtgtagaggatgcttcgttcttttggtgctttaaaaattacgcctgggttcagagcccagggtgcccacctttacacgatggaaccaccaggagagattaactgagggtctgacaccttcttaggtctgattagagacatttaccgtctaatctccctgaagcctccctggaggcttcatctgtacaattagaaccttggtctctacaacgcattatcttaatccagacactcttttctttgattccaggtctttagataataactctttcaaccaattgccaatcagaaaatctttcaatcagcctgtgacctggaagcccccagttcgagctgtcccccctttctggtccaaaccaatatacatcttacatgtattgatgaatgtctgcctgtaacttctgttcccttaaaatgtataagataaagatgtaacccaaccacttctggcacatgttctaaggatctcctggggctgtgtcgggggccttggccactcatatctggctcagaataaacctctttaaatatttttttaaaatcccccgattaagccagattgacaggggaacctacagggagacattaagacattcgttttttgttttgttttgctttgttttgttttgttttgttttgttttgttttgttgagacagggtcttgctgtgtcagccaggctggactgcagtggcacgatcatggctcactgtaacctcaatctcctgggctcaagccattcttctacctcagcctcctgagtagtgagagtacaggtgtgtgttaccacacttagctaatttttgttttttttttttttttggagagacaggtttcaccatgctgcctgggctggtcttgagctcctgagctcaagcaatctgcccgccttggcctcccaaagtgctgggattacaggcatgagccaccacatgtgctgacaacatgagttttcttctttgatatatgtatatgtttttaatgaactgaactgtgagtctacattgagtgacatgatgacaaccagccttcgaaactcgctgtgtggacattggtgaggacatcgtacccagcattacacattgaacaagtgggcttagagaaaatgaaggaagtttccattcaggaaggagctaaaccaaaccccagttgtaggggacactattgttctaactgaatagttaatttctttggagcaggccaacatgaaagttataggaatgaaatgtccatgtgaggttctcagcaaaacataagtaggaaaagcaactattttcttttggcgtcatgtgccaacctgccctgtgaatgcttggagggaggacagacttttgctctggagcattttctatcctcgtgtgtagccgacatccttaatcaatcccagcatgactgatttcctgatttctccacagccaaggtgaatgggataaaatgacttggaccacgtttgcatgcgatggaagcctggccaccagccttcctttaggagtagcaacctagcttgtcctagggtgcaataatctcaagacctggggtctagacaggaagaattcctccaaggaatcaaatgggcctcaagttaatgatttgggctttgcctcaaccagaggctggactacagagcagatctggtttttcaaaccatctcttatgttcataggattcgatttcaaagaattgagatagtatctcaattcttccttgtaacaacacccagagataagaactaccttaaattttacagataaagataatgagactgagaaagttttaagtgactttttctacactaagtagctgagtgtggatctgcgcatgggccactgaacatcagccactgaatgtgggtcacttgcccaagcctactggccctgaggcaaaggccagagaaaggaagccttggaagagatagtgtaataggagctgtggagtggggatctgcacactgggccatgctgcttgcagatgtgagcttgttgtgatttccctactcttgggatgccgccttcctttccccaggatgttctgtacgcgtgcatcctccttccctgctcactgtggtgcctcccaatcggtcaccccacttctgtcctttctcctctttaaccctttcgccactcagcaaccaaagtgatttttctttaaaaaattattttagtttggattcagagggtacacgtgcatgtttgttacatgggaatattgtgtgctggtggggattgggcttctactgttcccattatccaaaaggtgcacattgtacctgatagatacattttcaaccctcactccctcgcttcccagtctcccctgctcttcagagcccccagtgtcttctatttctatcaaggtgagttttctgagatgtaaatcagagattacgccatttccttgctcattactccctcgtgacatttcgtggtacacagacaaggagcacgtcctctcccttgcactcaccttctcctctgcaggtggttgttgcccgcagctccctgcgcccggctcctccttgccactcagacctcatcaacacctttcctgatcatctgggatgaacgcatcgcccccatgctactttactttctggagctctcatcctcctccctctttgtttccttggccagctttgtttttcttggcagcatgggtggctacctaacattggatgctgtgtttaattgcttatagtagacacttgtttaattgttcactcttcacccataaaggcagagactcctttgtcggttggttgctgctctctctcaccaaaatgtaagctccctgagggcaggggccctgactttcttggccattcctgaattccacatggctaaggcaattgctgatacatgatagacctcaaaaaaatgtttgttttttttcaatcaatgagaaaaaaaggcagcgttttgaattgcaatggagagaatagggaaataaaagcttcaacccagacctcatccctggacagagaaaatcccatgtactgcatatatggacaccaagatgggaacacataccccacccttcagtgcattagtccctcattctgtttccaaacctcacccctccctcggccccacatccctcagaatgtagctcagtgtcacttctacggcccaccctgatcaacttgttcatatccctttaagcacctacctggcaatttggtaactgtagatttctctgtcaccccaaccctggaaggcaggggtgggcttctccatcccagggtcccttgcatcgtccctgcacatcacaggggcttggggaacacctgataaatgatgaggagagtggatgagtgactagcaaagcctggagtcaacttttgatgccctgaagtcaataaaatgacacaggatgaaaaggtcaaaaagtttcttcaacggctcctgcaggaagcatttgaggagaggaaatgatattactcaaacagcattgactgtattttctactgtattttctatattcttgatgctgtggtgtttggtgccttgatcctgtagggactgcccatcaggatcagtgaggaaaaaaagacagtgttttgaattgcagttgagagaatagggaaatacaggcttcaactcaggccctgcccctgaacagagaacattcccatctacatagagggacaccaagatgaggacacatgtcctgtccttcagtgtatcgtccccctcattctgctagagctagcaagcagctccctgtgagcacactcaccgaaccagagcccataccctaactaccttctctatcaaacttgcgcataccaagtaatatttccccggcctgccctaagtcaccctagagccatgtaccaaaaaatcaggggtcacccctacagctcagagcctgtcaaaattatcccaagtatccaattctaagcgtggggacctaggagacctgccctgcttcatccattccttgctgtgagaacccaaggaaggctctgggccatgctctcccctcttcctgctgctgcctcctgacgcatcgtggtgattccctcatggcctggtgtggcggccacaccccctgcttctgggaatctgtgagcttcagcttcttccttcataatatcacttcatgcgtgtgtgagtttaccatgactaattaaaacaaactcaagcatttttagaacacagatcctgttccgatgcttttttgcatcccccaaaaaataaatccaatgaggtcatgcattcgatatacctaagagacagtgatcaacttgctagacatctttctatgcaaataaagcataaaaatgatgtacaaatctttacttagccaaaaaaatgtttctggtggattttatgcaagaagatggaaaaagaaaatgatgatcatggttcaaaatgttctagtttcttagggttcaaagtacagggaaaaaaagaaagagaaaaaaagtatttaaaacagaaagaaaaaaatttaaaaaaagaaacaaaaagaaaataacaaaatgttcttgctagcttcttggggttcaaagtagaagacaaaaagagagagaaaaacatagttaaaacaaaaagaaaaaaattaaaaaaagaaacaaaaagaaaataacaaaattttcttgctacaaaaggaaaaaagacagtcaaggggcctgacaatatccagggaagagagagacacaatctgctcctactctgcagtcctgtgtgtgtttgtccatgtgagtcctcatagcagaccagtcagagaaaaaagtcatcttggcatcactttctagagttaatcatttcatttttcttaagttaattaaactatttttttcttaatgggagagcgtcatagttttcccctttcattctttgagaggtaaccatgtcctccctgaagtggcagaaacctctgttgactgctcctatctgaaaggaaatacagtccctctccccttcaggagaatttatgctttttccactaaagatgcggatattacttacattcctacagtgctttaaaattttgatgatctttcaagtccattttgtcatctaattcctccaataagcagtgatataggcagagtagagaatgtttttacccattttacagatggagctcgaagatgaggtaaaagactgaggcttggagataaggccactttttccccgttaacttgaccaagatcagctgcctagaaagtggtagagaggagacaagaaacacaaggcagcagggttcagcccctcatcagtagctagtttcaacatgtaatagtttcattttggctgggcgcggtggctcacgcctgtaattcggcactttgggaggccgaggcgggcagattgcttgaggtcaggagttcgagaccaaactggccaacatggtgaaacctcgtctctactaaaattacaaaaaattatccgggcatggtggcacatgcctgtagtcctagctactcagaaggctggagcaggagaattgcttgaacctgggaggcggaggttgcagtgagctgaggtcgtgccattgttctccagcctgggcaagacagcgagactccctctcaaaaaaaataattttatttgaattatctttctgtgaaagaaataggttctggctcccgcacttcctgtgcactgatcttatttgatggaacaaaatttgaatgtgctacctatatcataggctgttcagggataccaagaaagatagataaatagacagatagattacgaatatagatagatagacatagagctagagatagagatatcttccacctatctgctcactatgccagggtatccttgaagcatttgttaactcgacacagccacagcatagaagaaacttgggtcttgaatgactgcatggagcagagtctgctcttgcataggagccccaataccctgtattctggaccctgctgcatccactcgggctgaagaattcaagaaaaagccacctatctgttatagcccttccctccagagagatcagtgtattagtaatcgccttatttattttgactttgatagtattttttgttataaaacaactcttgatgttattaatgtgagatagtccgaagattgtttcttctcactgtataatgaaagcaactggggcagaaataaccaaaatcaaaaagtgcattaaaaacagatggctgcaggtgtcctattatctttcatttgtgttaattaaatttagtgttggcagataatataaagagatactcagttcaatctgacttttggagaaattacaatttttattagtacagttatttccaaatattgcaaatatgagaacaaataacccccaactcatagtgattcaatgcaatagaggtttatttatgactcatggaataggctgcaggatggggggcattggggcactcatgtgggggcagcctttgctccttgcagtcattcaagacccaggtttcttgtatgctgtggctcttttaagttcaataaatgctttgagaataccctggcatagtgagcaaacaggaggaggatatctgtatctctatctctgtctctatcagacctgtatctaaaatctctgtctctctctctctctcactctctctatctttgtatcactgaacagcctatgacataggtagtacattgaaattttgtttcgtcgaataagattgatgcacaggaaatccaggaaccagaatctattacttttattgaaacataattgaaatgaaaccactacttgttgaaactggctgctgatgaggggttaaagatgaaatctaaaaatacagtgtcattttattttgtataaaagttaaagaatattctgagtttgctgtaggtttttacttcttcttttatttctgcagataactctgaggttattttgtttcgatgtgttgttgaaacaaagcatagaaattattcagatacatagtatttcctgccagtagctttgtcatcaatctgactgagacacatcaccaaggaaaagcaaactttaaatatgaaataggcagtcttcattcaaaatatttataggcatttaatatggataaccactgtttcacgtataacttttgcttaattataattgagaaagaacagtaagttacgaagaggacggtgattctctctgtttcatgcctcccagcacactagcattaaacaacaggcacagagatttttttttctctgtaccatgttttgttctggttatatttattggcatgtaattttgtgtttatggaaacaaataataaaaatagaactaattatatatatgccttaaaaaatgtacagcttggcacaagaaaaaatggaaagaaagagaaaagggtctttcactagagaatatttgggagggaagatggagtgggtgctgccaggtggatgtgtggcggaacctttttgccagcttgtttcccttgggccttgggccactttgttttctctgaaagtgctttctctttagcagggactttggtagcatgagcggaacccctaggtgttcatggaaacctggctgtccaggggcttggggacaccatgggacacgctgccaccctctagtggtagaatagagacgcacttcaccaccagggggtctcctctctgtcattgttttccagcctcaaaaagtcacatcctagccctgcgctcatggtggctcaggcctgtaatctcagcactttgggaggccgaggcggttggatcacttgaggtcaggagtttgagaccagcctgaacaatgtggtgaaaccccatctctattaaaaacagaaaaactagccaggcgtggtggcaggcacctgtaatcccagctactccagaggctgaggcaggagaattgcttgaacctgggagacggagattgcagtgaactgagatcacgccactgtactgcagccttggcaatggagtgagatgctgtctcaaaaaacaaacaaacaaacaacaacaacaaaacctcacatcttttttggataacatgaaaaccctatacttaaacccccttccctgacccagagattcttagcggtgtctgtttgagaatcactgaatttgttgcacaattttgacagctgagatttggtgtaatcattgttgaggcttgtaatacaaaaagcaaaatttctttttgtctctttcacttgtcaaatacagataatactgtaaccctgaatatgcgtacgtctattcaatagttaccctcaccctagtgttccctcagaggggcacacagaatcctggttgctaagcattgctttggtgcatgctgaagatcccagtaacttcaagctctctttattttgaattgtatgtctactaaggggagtgacctgggttccagtgaaatggtttccactgcacctgctcctttcacttcctcccctgctctgtcctccccttgctcacctctctttcaatttctccttagcctgccttgcctttagcaggagaagaatggtgagaatagagagaatctagtcctgagcatggtcgacctgggttctgggcaggttacctgtgccatgcccttattctacccgttggcctgtgcagggaggtgagcactgaggaaagacaggtgtgttcactctgcccaggtgagctccgggatgggactccctaggagggatcgtggggagggacgtccaggctaccattcagggctggccatctgggcttcagggacatcctgacgtctttgccttgtcctgtggtctccacagagacagtgttggggctcccctgagttgctgtaattccacaagtggggagctcccctcacatctctctgcttcctcggccaaccctcctctccagctgccagggccctgtctacctgacacttggaccttgctgcatatttctcagcttccgtccacctctcccatctggctgtctttgtgtgtgtgtgtgtgtggctttgtcagttacggcggggtttctgggccacgtggtccgtgctgtttgagccatcctgagctagaggctgtaccatgtctctaggggaaggggtgggtatgaggcctggagaactttcagggctgtcttgcgtggaggactgtctacaaggtttaggagccgggataaaggtagtccctgcaaagcccggacagccacagcccacctcgggggccatcgagtgctacctgggaggtctcctccccatcatttgctcaggctacgtgttagtcaggttctccagagaagcagaaccaattccttaactgtgtggtgtggtgagccacaggccagcaggctggagacccggggaggagctgcaggccagtcccgaggccacctgctgccagaactccctcttgctctggggaggtcagtctttgttccattcatgtcccctcctcattatggaagaccatctgctttaccaatttaaatatttatctcatagtccaccaacttaaatatttatctcatctgaaaacaaccttacataaacatccagagtactgtttgtccaactgtccaggaaccatggcccaggcataacatcaaccatcaaaaggcatttctcgggtttgcgtgttctctggcgtctgacccccaaagccacattctccttgtcctcaaggatgggtttctggcccttggcagctttgagacagatttgaggtatttgaggttccttggaagcgccagtcatgccctggtattctgtgtcccgggggccccgatgctgagcatggacatcaggctggttcacagtcggtgactgcagcaccctcaccagcctcgcataaagcaggaatgtttagccctgtcttaagggtttgcttggggaaggaaatgatggtgagcaaggtaggacttttcacatggggagtcattgtgcttacattgtggattacgatgatcccatccgttttcagagagtgttttctctatttgcttattgccagggtctggtcctggggaaagaagcaattgggggctctggtgagaaggcacaggggctcccccagaagcaaggacagagagagcacggctgtgcttgctcaggtgtgctcagcaggctgcgacgtctgcagcctggggctcctgcgcctgtctctttgatgtgagctctacctctccttcaccatccaggctgtcctggggcaaactccaggtggtcacttttagctgtgtctctgggcagacaagtctagacaagacaccactttcttctccactcctgtttcctgagtgtacctagggaactacaccaggtcctcccccaggcacctgctccattagtgactggtggccatcttcacactcccggtgagcaaggaagtggcaccagctgggatccttcttctcaagccacacccagctgagaaggctgaagtaggcaccgcagcctgtcctgtggacttgaactgctccgctgctgcaggcgtgtcctgccaggtggaacaaaaggaagaacacacttcacatgcacagtgcacactagaatgctatttaattctgaggggaattgggtgacccttgactccctcctccctctgacttgttaattttcattttctagatctcatggactttttcataaagcttacgttttatattttacaatttgtattgaagcataatgtgcagagtgaaaagcaccaatcttgggagttcagccaggtatgttttggcgaatgtgttcacctgtgtgacgccggtccccattgtgacatggagcattcccatccagccccagactacaccttccccttccctgcctcctctcatgatctgctgcactgcattccctacacagcagacagagcaggagtcatgcctttcttctaaggaacatcctccagtgacttcattgcactgagaagcccctcctggcccttgcaggccgctgtgctctgggccctactacagctctgactggtcctgcagcccccaatccctggccttcttcgtggctccgagcacaaaccccgtcttagcacctcagggcctttgcatttgctcccctgcctccatttctggaattctgcccctgagatctgcacgaattgagccctttcatcatctgggtctcaggtcaggaacgctaaccaagactctgcccttgaccaaactttagtcaggctcctctgagccatcttttcaagtaggtcctgtctgtctttggtctgtccagccccatcttagcaaagaatcctgctaggtcacccctcgactttctaggccatccccccacttgctaggccaccccctcacttgctaggccacccccccacttgctaggtcacgtctccccttgccagttcaccccccacttactgggtcacccccatttgctaggtcaccccctcactcactaggtcacccccacttgctaggtcacccccccacttactaggtcacccccacttactaggtcaccctccacttgctaggtcaccccgtcacttgctaggccaccccccttactaggtcaagtcaccccccccgcttgctaggtcaccccccatttgctaggtcaccccctcactcactaggtcacccccacttgctaggtcacccccccacccttcctatctgactgtgttatttattccccacctttgatgtctaagtctctgaccaccgttatgaagaatcctgttaggtcccatagtcaagttttgagacagctgccacaaggttatggaggaggaaatgaagcctccattttcgtgctgggtttgtcaagtccattcaggtagaaagtggcaaagtcaggcttggaaatgggttttgtgactccatgtttctcctcgttcagacctgccttggagaacctttccctccacgtcttctgtctgtgttttagagaactggaaaataggccactttaacatggtctctcctacaaagaggtaagaagacccagcagaagggcagaagaactgggagtctggccagacctctggatgaatgtcagggttgttgttatacccaggactgttgtcaccctcttgtctctggacatagtgacaagggacaaggcaaagagagagggcctgtgttcttgtggacatgtggttggcaaggttctggccagagtcggaagggccaggaccccacgttccttcctcctatgtttgtatcccattcaaaccaagattaaaattctaagccctccagccaactgaatggacgcctcctctcagcccaaggcattctagtgttaacctcaaacactggttcaggccatgatgggacgtggggatcaggaatacctcatgatatcctcctcccattggaattcaggcacagctggccagcattaacattaaaacagagtgcctaaggccacgtgcggtggctcatgcctgtaatcccagcactttgggaggccgaggtgggcggatcacttgaggtcaggagttcgagaccagcctggtcaacatagtgaaaccctgtctctactaaaaatacaaaaattacttggcgtggtggtggatacctgtaatcccagctacttgggaggctgaggcaggagaatcacttgaacccaggaggtagaggtttcagtgagccaagattgtgccactgcactgcagcctgggcaacagagcgagactccatctcagaaagcaaaaaacaaaaaaacaaaaaacccaaatcctctcttctctcaacatcctctctaccacttctctggtctacatagaaaactctttcgaagagctagtgttctgagatacgacttgggtttttgtttttgcatctgaagaatcctgaattatcaaacaccagaaaagcacaaacacaaaagaacttgctgaaaggactttatttgagatgaggaaacaaagttgatggcaatgtataggacacacgacagtttccttctaggtcataaagtaaattatgaatatatttctctctgttctcatccctcagaggcagcagaatctgtggttaatacccatgacagtgcaggtcccataggaatattctgttgaataacaggaccttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagagccattctgatatgctgtacttatctgctccttccctgtcacacacacatctgaatgcacccatatgactgtctccagtttgcaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaaatacaaaatttagccaggcttggtgtctggtgcctgtaatcctagtgacttgggaggctgagggagagaattgcgtgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcctggggaggtgatcacctaagagaaagagccagctgttggatctaattctagaagtgcttggttttcctctctacactcctagctctgcaatgctggtgtctcttacccaaagctctaagacttgagcttgcatcctctgcaaaggagacggcaaagtcctggtcatttgccccacgctgctcctgggcatcagcctcataagcttttgcctgcagtggatcatcctcagcttggagtggctcagccttggcctggagggccacgaggagaacagcagtgaggatggtgagggttctcatggctagggtcgctggaggagagagagcaggagcagatgtgtggggagtgaggagccagcctggatttataggtctgctgggagaaggctcagggacagatgttgcggtgagacggggagtgcatgtgattggggagcagaagagctacccttgccctccatgtccctttgatgctcctttgttctccaagcttcattgtagtgtgaggctgtttattgagtgtctgttctggtcccagctgatagtgatgataagaacagtgttacattgtcctgttttccatctgctggaatatttacttgttaatattcaaaaaagaaaagaacagtgctttcaatgaataatttcaggaatcaaatgcctcttattttctgaaggtggggctggccactctctggaggtctagaccttgaggccagagctggatcccgctagagtagagagttaattcattgcaggattcagggggcatttctgccctcatgaaggaggctttgagattatggggtgaataggctcttgtggggcacagtgtggagaagataatgaccttatcagcctataagggaaaagaactcagtgggatactaggtaaagagttagtaaaactaaagccaaaagatttatttcaagaaacccatgtgatctgaatgtatcaactaaaatatgtactaggtatttctctccactttgagaaacatcgaaacaattgacatgcccacaatccccctctgaaattttattttatttttaattttagaaaatgttgaattgcccacaaggaccattcaaagggtaaaaggagtaatgagcctccatccttgccccagccctgcagctctgctccaggaaatctccacttaaaaattaaacattggtttgtgctttgttttttctccctaatgctgtaatttgaatactttgtagctcaaaacatatagaactctaccattattttcatagtctcttgtttctggtcttctattcaggtattttatccattttgagttaagttttgtatatgccaaaagagaagggtccagttttattgttttgcatatggaaatagtattcccaccaccatttattgaagagactctcctgtccctattgtgtcttcttcatgccattgtcaaaagttacttgaccatatgtgtttcgatgtgtttctggactctcaattttatttcactggtatgtgtctggttttatgccaataccatattgttttgattaccgtagctttgtaatataatttaaaaccaggaattgtgatgtcttcaactttgtttttttttctcagaattgttttgtctatttgggttctttcaccatttcatacaaattttaggatttttttttttatttctgtaaagaatgccatggggattttgataggaattgtgctgaatcggtatattgttttgtttgggatagacattttaacaatcttaattcttccaattttcagcccaggatatctttccatttatttttacattctttaatttctttcactatttttttttttttcattttcagtgtgtagatccttcacctccttgtttcttcctaggtgttttattttttgatgctattgtacatggaattgttttcttgatttttgtttcagttttgttagggaatctatgggcatttaaaaatgcatttgttctgtatttatttgaattttgccttcatttacccagcaggagatgaccatttaactaacatctaaatttcgaattaaactttccctctccaacccaaactgtaattgtccattgtgacttatagctgtctatgcctctttccccagtagttcatgggacaggcaataattactctatcacctggaaatcctaccctggagctgttactcagataccctgatctagctaacaggacaagatacttctgtaaataagtgatctaatttgtcttgacttaaaggagcattttggaattgtatgctctatctttggaaactaagaagtgttcccagcctattttaattgaaatagaagataatgcagaccaatccccatgggcattggtaaatgtttagacagatggggtgcaggaaggcttatcaggatccatatcgcagcttgtaaagtcaccacaatcaccacgccaacagacggaacgcctggaagtaaacagaacttctagaacagtagaacatcaaagggtgtcagggacaagggaacttcacgtagttcctttccctctctctacttaccttcctgcccctagagtcacatacatgcaaatactgaagcacaagctctattttgaagagcccatttactctaggatccagctttcaatgatcatgcacaaaatcgaggcaggtatatctcccccttgtttagccatcaggctcctgcaagagaagtaacctccctaccgtgacccgcagtcacgaggacctcatctctgttaactgcctttcttgagttaaccccaccccactcccacatggaagccctaataagaaccgagcatcttggagatgccaccgagatgaagttgacttaggccaagggctgtctctgttgtcctcagtggctccagcatacctccaccctgagatgtcctcacacatcagacgctgacctagcagagcccacactatcttccagtaaagaagaacctgcccttacagagaactgggcgcgcagcactgcagtagcaccttaaggacagcaggtggccctcctgcccttaaacaggagttgacccaagagggacttcaaatgggagcgctgtaaagtgctgttcagcaaacacattgctttcttctgcaccccaaagtgtacatattacaacattagttcagggggcacagaatacactgctgctggttccgtgtcagcggtagctgctggccctggaaggctggcctgccccgtctctaacctagtgtcatgatgtcgttcccccttgtgctggctgcggggctgaggacctgagtctgggggcctctgctctttctcctgggtggcaatgctcctgtccctgcctccttcccagtctgtggtggggactcgacagccagggcaggtcaggttctcagtctgtgctgaggtctcacctgggccttgcctctgtctcccccaggtggctcccaaaccccaattagaacagagtgagtctgtatctcgtggtccctttcacctttctttctgggctgcaccagaaccttggcagaaatcagtggtttaagcaaaaaatggtgctacatgtaaaagtctttgcaacactttcacttccacccccacccaccctgcccccagcacagtgtcctggacttgccaccagtgtcaactctgagtgtagacacaactgaaactgttccttcatacacatgcagttcagctttcagacactcaacaagagccttgacaccctcaagctggggtaaatatcctggggaagctacaggtgggggtgcaggtgtgggtgtgagaggagaaaggccttcagcagcagcaaggatattcccacactctctgaggctgtctggtgaccccagcagacacagtgagtgtggaccttgggcagggccctgggacatggttttgacccagtgtggaagggcagttttggaacagagtgtgtgtgttagcgtggggtagagcgggggctgcgtgggggtgagctctgagaactgtccatctcccagcccctgagagtgcaccgccctgtccctcccctcagccttttgtccacctccctgcagggagggtcctggtgctgcctgtgccacacagcaactcccgggcctgcagatccagctgggacaggcaggagctccaagtcccctgccctttgtctgcctttcccagccgcctctcacatgctgtctatgtgtctggtgttgttgcctgcagcaatttttacaaatgactatgaaagaataactctcttgggctgttttaaaatgtggtcccaattcttggactcttctcccacagaaagggaggtttacttctttcctgttggatctaggtcgggtgacatcttcaccaatagaatgcacctgacttagtaccatgccgtttgctgggcccaggtgctaagacactggtatttttcactttcaccgtcttggatggcgctgcagttggaatatttttgtccctctgaaattcatatattgaaatattaaaccaccaggtgatagcattaacaggtggtgcctctggggaggtgagtaggtccggagggcacctcatgaataggattagtgtccttatagaagagatcccaaggagctccttcattccttccatcaggtgaggacacagtgaggaggtgccatctatgaacgaaaaagctggttctcagcagacaccaaatctgctgccaccttgatttggacttctcaacctctagaacactgaaaaatatatctgttgttcataagcaactcagtttatggtatttttttttaaatagtggctcaaacggactaagagggctggtcacttgggggcccagacaccgtgttttgaggaagcctcagcctcgcacaggaagatgaactgagggcacctgcgagggtgagctagagaacacagaacagccagctttctgggaaaaaccaaaactctgatttacagtgtttgtaaatttctgtggttagaatcctcccagctctggaccgtttaaaaaatgtcacacaaaccacctttctcatgagccggcatgatctggccccagcgcatcacaaggtcccatccctcagccctgtgagagctcccagctgagccagcactgcctgccacctgtgcgcgagtgtctcagccctgagctcctcagatcccagcagaacctctcctctgagccaggcccaaattgccaaggtatgagtgaagacctgatggtgctgtttcagtccactatgtttgggatatctttccacacagcagtagatgaacagagggcattgtcacagtcttggcgagaagttggacttgtgcatttctgcgtgtgtaaacttctgcttctccaaaatattggcgaagtaggactgaatcctcttaccttattcccaaagtgtcacaaagagcccatgatggtgggagcatgagattgtggactgtttggagtgaccgaagaaccctctcacccattcctagtttaaattcttcccgctgggagcaggggtggtgtgggagccaggtggggtctcaacctctgccctcagtaacagactcagaagaggccataggactcaggagttggctgaaacaacagggaaagaagtagggattttctctaggagattagctgcgaagggcacagagagatgaccatgaatgacatggctgtcacctggggagagatcccaaagtaagatcaagagaaacaaaggggaaaaaaggtaaagacgacaaagtaactcatgctttgagtccttggaccaagcatttcctaaagccagaattccttggtatgggagtgaaaatgttgactcagggctggacaaggtagctcagcttgtaatcctagcactttgggaggctgaggaggaagaattgcttaaggccaggagtttgagaccagcttgagcaacatagcaagccccctgcctcttaaaaaaaaatggtgactcagcttgacctgatttctaatgttttactccaagactccactaagatgcctgaaaaagatcaaaaataccaaactcggagagcctgaggcaaagacagtgccgtgcacaaggacaggagatgagagcagatgacaagtgtcccaatgcagcttgagggcagatgacaggtgtcccaagagcagcttgggtatcaggctccctggtgattcccatgcacagcccccgggagaacagccttattgatgctgatcagcagggaaggagggacggctacattagaggctggaaggacagcgggtgagtcagggatggggagcttcatagttgatgttcagaaatggaggaattccaggtggtggcaggagctagtgggtggccatgggttggagggctgggacaaagagggagtggggtcactgtcatccaggcggacaaagcactgagaggctgggagggtgaccggccaggtaacattacagtgaaagaccgtttcccgtaatcttaagtttctgagtgagttgagtggctttgagcagcaaaagggaaaaatacataggtttagaaaagagaataggtagttgtctgatgtcttccattctggttctgcttgtaagaagagttcaagttctcaaacagagaaacagaagagaaaaaaatggctgtcttttattaaaaaaaaatcagaaggcttttaagaaatgtcaaggaagtatttattgaacactgttgaaataagagtcaaaacgctgcaatagggtgagccgttgaactcaactgtcctgaagcccaaggcaggaatatgtaggccctgggttaagctagtggaaaagttctggtggttgttggtggggaagttgagcagtgtgattgggcaatctttgtttgctaatttattaggagataggctcctgtcttcccacagagacaaggctgctatccccttgagtaattacatttatagggatgaggcatctgacttactctttattgttctaccactcaagtgattcaaggtagaaaatgtcttgtatgtcatcagtaaacatagagtgcatccacatgaacgtttctgggtctcacttgaggctgagcaacttgccctggttgtttggagaccctcacacctctccctgcattctctgtccccagagtttgcagctgtcatagcccaccctagactgcagtagcagaagccacatgtggtgctcccagtgtgtctatccacacagaggagcagggaggctccttcctcgtctggccctttcctttggattgatggatgcttctcagcacatcaacctgaattctactccatccttctgtgttgcaacagcaattcctcttaattcaatggaggttgacctcctcctgcatagctcttgccctgattctacattctctacctaattttctgctttaatcattcttttattctattgaaagtttaaacatctttatgtttcagtttaagattcaccatgaaatctatccttggcattccatgacagaatggtcttttcctacttccaaaagtcctaatgcttcattaaaccacattttacccatcatagtctcctatattttagtctttttaattagttttaattagtcttttttaaggaatgttgtcacatggactagacacacgggctgctttacctctgtaggcttcagtatttttttcgtaaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggaaggccacctgcctctgattgtgggggttgctggtgtttaagctttagtgccatgggtcccattcaatatctaaggatcgggtttcctggcttggatccagtcaggtggcatttggggttttgcccctctagcacattgcctcaacatgccacagttttccagcctggggttcaattttgtgtcaatataaattttgagtacaattaattaatttagttgaaattaatttattgatcatgtgcaacgtattaggtggtcatctatgcactgtggtaagatgatgaggaaaacatgcagcttccctcccagtgttgggagacaaatgttccagagagtaaatgaaatgcacagatgtgagatagcttacaattctacagttaaaaataaagagaagagggggatagaggtcaccagggggaactagttgcaatttgaaattaagaaatcagcaaagtcctcagtgacaaagggaagttctagcagagaccccaggatctagggcgcaagccaggtggacttctgggaagtgcagaaaccgcgtgatggagtcagccggactcagtggacggttaggagcaatatgcagagttacagcaagaaccgcgtgacttcaagtcagtggcggttacaggaacccaaggaagactgtccccctttcacatcctgaaacccaaaatgtcaccttcaccttcaatacaaggggaagaccttggaccatttctttgtcaatcacagacccactgtgtcttccctgggacctgtattgggttccccagctgtgaagtgtctcagtggggtgcctggacccctgagctgcctcttcagacaggcagagcctcagtctggggctgagacctgctcagaatctgcatgggtagatgtggagaacacctgcttccttctcctgggctctgggcattgtgggtggttggtgttggtggtcacagctgtgtcttggcccatcagattgttttggtcaagaatggggaataatcctactagaatcactgtccctttatttgcaaactgtagtttctctgtcactcttggaagttgtgggggcattctatgaatgaccctccagataagaggagccatggcttgaacagagaaggtatttttccaagcatgtgtagtggattcataaactggaactgctagatccaaaatataagaaatctgtgggccaagctggacttgtccctggagctttgtgatcatgtcctcataggccgttgacaagacatcctcaactattgttaaaggtacagtgggtttctagggtagggacagagaggagagacaggaagagaggtcacatcacaccccagcaagatgtcagcctggccctcagggacacccgggttaggcagtgaccctgttctcttggaggggaggaggaagacaagctcaggaaggtacagaccccacgtgtgctgtgcctgatggggaggctgcagttgaaggtaggacagcaggggacgctgtggcctttccgggaaatgctctgagcatctcagagagcgctcctggttcattccctttccctagacctggtttcttgctcactcactgatgtgcaggatgttgtggttatcagagccgcagcctgcagcaacaacaggaatgtaaggtttctggtgaagctgtattttcccagcagaatcaggttctcagcagctttaaggcaacccaagagagtgcgcgttgcaaagtgtagtggagcatttgtgtgtgtgcgttttctgggtgtgaagacgactttatgggtgtgaaatccaggtcttcatagacgtggctgaagggtgctcttaatgaggacatcccattgtgggctgctgtgttttgtgttccatgcaccccgcctttgctaacaacccatttccctcttaattaaagttgtttcagtggatctcctataaccctatgtcttaaaaggcaaatgtgtgacctggacatgttcaataaaactccaatattttgacgcagaggatggtggtttttcccgagaagtagtgaggttgtgagtagctaaactggaagctgacgttgattcttttgcctagtatatgagagttgtctttgagagtgaatccattcaaaatgaggcagaatgaaaagacagagcagtggatggtgagatcagtggcatcatttgtgccttcgtttcagtttgtgtctgaagccatggctcctccttaaaaattctagattttgaaactttaatttgttccaaaatattcatgtaggattctggcagttgctttctagtgtcttgacacagacacatatcaaattttaaagaggtgtaaacaaagacatcttgttacgagatatatatttaggatcaagaaagatgttaaggacaaagtataggagaaacaaccatttcctgtagctctcaaagcaaattatgagctcatttttctctattctgcaagctcagctgcagaagcatgtgaagctaacaccaccgatgatggcgttcccagcatgacattctcttggacagcagaacgttaatcgacacgcgtgcagcagtatgtgaaactcacaccaccaatgaggcagttcccaacacgaagttctgttcgccggcagaatactaatctgcaagagcagaccatgccccttgttgagcctgggaacacagaggaagcatgagaaattaagcaccaaggtcagcggtgggtggtaaagggaatcttggagaagtcacatgctggctgaccggtgatgctggctgcattagtgccggtagcacaaacaaccttagtcaataggaataaatacacagagcaatgctgctcatacaggatttgagactcattctcttttgctctgatttgtgtgcttttgccccatcagacacacacctgaacatactcttaagcccatctccagtttttaaaatttcctttgttggcagaatgaaatattttccctataatatctacttgtttagatccagaaagaactggtcaatctgtctctccgtatcttaaccctagcgaattttatagacataccttggaatcaagtctttggagaaagaagactacttacatttgtttgtctctctattcagtttggagataagaaaatcgaggcccagagatggtaagtaaagccacctaagtgacatccaccattgagatgtgattccagagcccatctcccatccgtctctctagactcggtagcttttttatgctggcctctctcacctgaaacctgaagagcagagcttttatcccatgcaaaggaaatagatatgtcctggtcttctggcccacgctgctcctggcctggagcctcatcacctcttgcctggagtgggcctgcccggacctggagggctaccaagagaatagcagcgaggagggcgataatcctcatggctggggtgacctggaggagggagagcaggagcagctgtgtggggagggagaagccagcttggatttatagctttgctgggagaaggcacagagataagaaacctttggccttctgagtgagaggaggtgtgcattttgttagagaggatgccgactcctattggccttgacatccctggaatgctcctctgctctcccagctttcttcacaggaagctctatgtttagtgtctgtgctaggttgaagttgatggtgatgatgaggaccctggcattttttcctgttttcaggaaatacctaatatttcctggttaaatctttaatattctaaaaagaatggaaacagtgctttcattcaataatttaagagagcaaatgcctcttatttcctgataatgggccctactattctcttcaggtctaaacactggtgccagacctgtattccggtggagtagagagtaactcattgcaggcttctaggtcattataccctcatgaaggggcgactgaggtaatggggtgagtagtctcctgtaggggccagagtgaagaggacaatgaccttatcagggtacaggtgaaatgagctcagtgagagagataaagagttgtgtaaggttcatgagttgctaggtgcatacacgtggtcctttctctcacagcatgtaaaaaatcagctcaacatggattgaagactcaacatagacttgaaaagacctgaaaccatacaactacgagaagcacatacaaagataaagctttggacattgacgtgagtaatgatttcttggctatgacaccaaaggcacaggcaataaacaaatgggaaaatagacaagcggggctgcattgaacgctaaagcatcttcatagcaaaggaaacaatcaactgagggaaacggcaacccagaaaatgagagaaaatgtttgcaaagcctacgtggtagaaggggtaaatatctgaatacataaggaagtcaaacaactcaatagcaaaaaacaaacaacctgattgaaaaacagacctaggacctgcagaggcttctctcacaataaaataatgttttaagaagctgtgatcgtctttattggacatgtcaagtaggacacgtgtgtttggaaggaaactttttgagtttctctattgacttagctagtagccattacccccagcagccgccagacacccagatagaagttcacagcaggggcttcacccgctgggtccctctggggtggccccacagtgagaggtcagactggggacacagcttcaatattgaaacctcaatgtgaaagtttaagttttgtgttacttacagatcctcaagctaggcagggcgagcagagagggcagacagcagtcctgtgttccaggtcttatgtagcaagagcagccatgcacacagaggagaggacttccttatttaagggtcttttggtatcaggtgtcctaatttttcagggttactttctattgggtactttaaataactgttaacaagggcagttgagaaatttggcagaaagctggagttcaagcaggagtccacggaggtaccgacccctcgtctactttggtcagccctggccaggcccaggcagcaatcaactatggattcctcatgactcctaagacaattgaccccatgatacctatgctggtggctgaggctgaactacctggaccgagggaatatttaaagccaccaggagagcctggcctgcatattgttgtatacaccttgcgaggagactaggatcaaaatgccacccacacacagatgaggatttggaatgtggtctgaactgacctccccaggccctggggtctaaccataaaaacaaatccaagccattcagacaagtaaggttggagaatacctggatgagactgaataccgcctgggcttgtgttgctggatagggcaggttgcaggctcccgagtaaaggatgtgcatatagcatgtggttccctagaggggacagtcacctttttgcttggccttagatagttcaagcctaaatgactgtctaggtcatccaggccaaggactcatcaaatgattgcgtgacacctaatgtctgtcagaagtcccttaggatggtggccaaagctgcagcgagattggtgttagcttgcatcaccttgtgttgtgagctcaaataccctgttcccaaaccaatcccgtaggcttacgagtctccctacacccagagttaggaagatggtcactgggtgggggggatgcataagctttcccttgtgtggtccctcctgggttatttgaaggggagtcccagggagactagtgcacattttaaaatgtaccactctccaccatcctcctccttgtagtgaggtaaacgggatgaggtttctggaaatgagaaaagaatgcagttgttcctgagggaatgaatacctatagtgaggttgctgaacccagtatgcagtccaggcagcccctgccgccatgggagggccgtgcacagcgctggtccagcaggctgggtgctcagggcctcccctgcagctctgcgtgaaggcagcaggcactgggctatggaggactgggggcagcggcgctctcagtcttaaggagggaagaggcatctcaagcctcgctaggggtggtcgctgttccagagcagtgaagtcggctgcccctatgaggaagcagtgagttcctgatctgttgcaggcccagcaatttcacctttggaggaagtgggcactggactcattccagcagaggaagaaattagggctatttggggaactgggccccagatgatggttttaggttctagggcattagtaggtgcctgaagggcccagtggatatggatgtagaggcaaaatgagaaggggtgtgtgtgcacgtggggaaggtctggtggttgtggggatgtccagtgtcctgcagaagtgaaacctggaccagcctcctgcacacagaacacactccaatccataggcattttcctagtaacataggagagagctgttattggcagagctggttagatttgggtgtgatattataacagacaggtcttccaagtccatattttttggcataacttgtagggcagcctcctgatctgatccaagccttgtggtttccttgcagtaggcggtttaactaatgggttacactgaagacaaatggggatcccagcaaaataccattctaaggggtcatctgcagggtcctcaggaaagcatgagctaagaaagcacgggtccaggtactggacgtgagccaactccatgtcccgggggtggtgagatccataccttgcggcaggaaggagagtaaggtgagtctggtttggggatgaccccacagtcaagatgagattccttggtgtctctggttctggtgaggccactgtttcccaggacaaacccttggatcagagcactgtcttctgaggtgatggcctttcgggtaggggtggcctttccagctggtcactcaagaagagagagggtatgggctggtgttgcacaggcctctggcctctgtgggactccatggaagcgtttagtgaaagcttgagtggtgctttccttggtcgggggataggacatttccatccacaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggagggccacctgcctctgattgtgggggttgctggtgtttaagctttagtgccatgggtcccattcaatatctaaggatcgggtttcctggcttggatccaggtcaggtggcatttggggttttgcccctctagcacattgcctcaacatgccacagttttccagcctggggttcaatttctcacagtggctgtcctgttccagcagctctctgggatgccaggccccaggcctaagagcagccgtacaacatttacatacataagatacccagcaaggccaaagatagagagcactgacagcttataactcagggatttcctcaaggtacttttacgtcgatattgattatggggtgggctttcaccaacatttcttcagagcatttttctgcaatcgacacaggacatggtgatggtagttccatgtggtctttgtctgatgtagttggcgtcctctagtttgatggctttttctcctcatttagtgacccagactgtaccctctttgggctgcagagaaacaatccccacttccttcagggaggagtgagtgggagatattagctacctttcaaagcaggaagaactggagcttctgctggaggctgtatgtcaagaggtgaggtctggtgtagcagaagcatcttagggctgctctgtggcagctgcctggaccatcagtccccagaggatcacagctcactatctgtattagtccattttcatgctgctcataaagacctacccgagactgggtgatttatgcaggaaagagatttcatggactcacagttccacatggctggggaggcctcacaatcatggtagaagacaaaaggagcaagtcaagtcttacgtgggtggcagcaggcaaagagagagcttctgcagggaaactccctatataaaaccatcagatcttgtgaaacttattcactaccatgagaacagcatgggaaagacctgcctccatgattcaattacctcccaccaggtccctccaacacataggaattcaagatgacatttgggtgggaacacagccaaaccctatcactgtccatcctcgatcgagtctttagtaaatgtttgatgctgagacagtggacatcttgtgatggtatgagggggtctcattattgcagaaaatgtgggtgatggtatccataagggaaaaagagctcaactcttctgtgatcaccagggtgggtgccatggttggtctggtccaattgtagaagagctggtggccatggtgttgagaattaagatagttaaggctctcaaaggagcttggttcccttgatgaaccacttgtagggggactggagcctttcctaatttgacttagtctgtgctcatgccacaactttaataagcatgactttaggaggccactgtgttgcttgaggaggccagtggctaagtgagggtcccctaacccccatgctgagttgcccagcaccaccctgaagtgggagccctgatctgcatcagtgatatctggtggttcacaagaggtaatagagcaaatgtcacagaaagagagcacctttctctaccaagagccttgggttggaagagtcaatggaagtgcggtggatgtgtgtctgctcctgcacagcagaaggtggtggctgtgatgggagaggcccagtgaagtccatttgccaccagctgaaagggtgatggcccaggaacaagggattgctggccacagttttgcttgcctgaagctatggtgggagacagctgtggtgtgggttgccctctaatgtggctgtagctctcatgatctggggctgtaggactccactctgtcagcacctgaggaatacagaacttgagattctggagtctgtaaaaataagaggatctcacccaagccctgggaggtgcatctgaccgctaacctcctggggacaggacatcaggggctgtcagcaggctcagtctggaggccaaagatggcagtcgtctcactgtggatgcctcacccttcgagtggtggaaagtagcctgggcatgtttgttctgaatgcatgaggcatgaatcacctataggaggactggagtgtcccctaatttgacccaaacaggtccacgccacagaggccattccagaggcattggatccagggcactcacaatatgttgggcacagcccaggaatctgtaaaaactgtccccgagtgggggttatggccacagcaacctcccctgcaaccggcaccaccagctgtatggctgggctcagcataccctcccctcctatgcaggccctgctgtgataaatgtgggaggtggttgccggccagtgggctcccggcctgcagggcagtgctgccttccctgaggtatgtggactccccatgtccaactcttcccatggcctcatcaggtcaccaattgttcgggcaatagggtcgctgctgctatttctctctgcttgtaggcaggagctgaataacagggaaaccatggcctcagcttcctgtcacttgaaaggacttaagtgccaggtttgccttgtcctacaagtgctgttcccattttcccagggagacatgaatggctgagcctctgtcaggaggagtcagacatggggcatggctggagtctggggacacagcagcaccggaacctgtcctgtagtgcctatgtctatacgggcattgtgtgtagtggtagccagctttttaacgggggataatgagctgcagctgccaggaagtttatgcctgcagaagcccatagccaggatggacgtgctttctccagaggctctgggagtcatgattggtggtactgagggcctctatatgaaactcagaacccgggacctgggcatggcctgagagaccacctgctgagccagctgcatgctgtatcctgctgtggccccagttaagacatggagggcttctgggtgacagtgtctgtgggcctctgcagaatggacaagtgaggtgtaggtgcaggcggaatgtcccagtatgcgcagggcctgccacaaagtggctggcaccctaatggtgaagactttggttttaactgcaaggtgaatttggtggcccactgaggaccaggttatctctagaatctttacagcagtgcggggcctgaactttgtgtgggttgtggcccagccatggtcttggaggaagccactaaaatgaccagcatggttttcacttccttcttctaggggcttctgaggaaaatgctatcaatgtaatgccacaaggtacaggggttcacactgaatcacaggaagtcccgggggcacgagttatgggcagtagctggcttactgagacagcctgagtgcaatttggtaaatgtgcactgggtcccttccaaagtcaaagcaaacacagactgcgacccgtctgtgatgggaatgggcagaatgcattggccaagtctcctgctgtgaaatgttgtgccctgggcctttgtatgccctctgttaacttgactgtatctggaatcagggccttaatggtcctggaggacaatctggtggctgctctacttggattccagcgccacagagtggcaagcactgtttccgtcttatattttagtggaggagacaaacaataggcaaagttatgatgggtatgatacactatgcagccagtggttattatacagaataaaaggataacattgaggtgacctggagtgcccaggtgacacggtgttgggggcagggtgctgctcaatagtgtcaccatggcagcctcattgtggagagaacatcagagcagaggccaggaggggctgggtgagtgctgcagaaacctggatgggtccaggaaaagggagagcaggtgtagcagccctgcagcaggagtgtggcctggcccatgtggtggcctcaccagcagcacccggagtggtttcaggaggtcaaagagaacacatgccctgcaggttgctcgagtcagtggtggctgctggtgctgccttttccatccccaacccattgtcctgaggtcattccctcccatgcatggctggaggggtggtaactgtaggctggggggcgctactctgtggcaggggcggactcagcagcccagggcccgtcaggttctcagtctgtgctgaggttgcacctgtgctttacctccttctcgcccacgtgactctcaaactccaacccaaattagaagagagggattcatctcttgtggtctctttcacttttctttctgggctgcaccagaaccttggcagaactctaaggtttaagcaaaaaacaaaaaaagctgttttgtctaaaaatctttgcaacactttcgcttccgtgtccatccatgatctccccagcctgagtttcccattcttttcaccagtatcgactcccaggcacagtagacgtggctgaaactcttctctcatccacatcgtcttgaatttccagggaatatttaaacgagtctggacacttaataagagcctcgacaccatcagcctggacaccgtcagaaccttgacaccacgttctggtgaagctgtgggtgggggtgcaggtgtgggtgtgagaggagagagaactccaggagcagcaaggatattcccacacatgctgagggtgtccaggggccccagcagacccagggtgtgtggaccttgcgcggggttctggtacgtgatttcgtcctggtagggaagggcagtcgtggaacccagtgtgcacgttagcatggggcagggtgggggctgtgtgggggtgagctctgaggaccggccacctcccagctcttcagagtgcaccaccctgcccctcccctcagccctttgtccactgtcctgcagggagggtcctggtgctgcctgtgccacacagcaactcctggacctgtagatccagctgggacaggcaggagctccgagtccctgccctttgtccgtctttcccagcacctatcaggctgtctgtgtgtctggtgttgttgcattttacaatatactatgagagaataagtccattgaacagctttaaaaatatgggccctacatcctgcatccgtggctcttcccaaagaaaggaatgtttatctcctctcctcttgaatctagtctgggtgatattttgacaagtaaaataatcctgacttagtgctatgttctcttctgggatcagatactaattaactggtatctttcacttcttcagtatgggatggtgttgtggcctgaatatttttgtccctatgaaatccatatgtttacatcttaaaccccaaggtgatagcatcaagaggtttgggcttttacccagtgatgagatcaggagggcacggtcctcatgaatgggatttgtgcccttgtagaggcgaccccagagcactacgtcattccttccaccaagtgaggacatgtcactgaacacaggtcccgctgctcgccacgtgcagcagtgataactggacggaggtggggtagaaagagagcgactttattaaccaaaactactaagggggaaatggctggattcacatcaaagcaaccacttcaagtttttggggagaagacaagagtttaaaaagggggacttcacatgggaggcatgcaggggttaagctgggcgtgaggtctttgtgtcttgtttcggtggctaccttgggtctctgtccacctggcccatgggctggtgtcctctccacaatggctgcgctgttgactagaggccttgaggtaatctgtggaatattccaagatatagtagtcaaaatgttaacttagctcatcatgctttctgacactcgaattcaagacccaactaagatgactgaaaaacatcacaactaccaaactcagagaacctgatggaaacacggtgcagtgcacaaggacaggagatgagagcagaggacaggtgtgccgggtgcagcctaggcatcaggctcccaggtaaattatttgatgcacatccccgtgggagaacagccttttttttttttttttgacagagtcttgctctgtcgcccaggctaaagtgcaatggtgtgatctcggctcgctgcaacctctgtctccttggttcaagccattcttgtacctcagcctcccaagtagctgggagtacaggctcctgccaccatgcctggataatttttgcatatatatatatatatatatatatatatatatatatatatatatatatatatatatgtatatttagtagagatgaggttttaccattttggccagtcttgtcttgaactcttgacctcaggtgatccacccgccttggcctcccaaagtgctgggattacaggcatgagccattgtgcccagccgagaacagccttattgatgcttatcagcagtgagggagggacagctacatgagaggctggaagtacagttgatgagatcagggttggggagcttcttggttgatgttcagagctagaggaattccaggtgctggcaggaattagtgggtgtccagtgggtgaaacaaagattattggaaaaaagattgttgagggtcactgtcattcaaaggtaaaaatagtgagagattgggagggtgacctgccaggtaatagcagagtgaactctttttccaggattcttaatgagttatttggctttcagcagcaaagaaaaaaaatacacatattcagaaaagggaacaaatcattttcccatccattacattctgctttttcttgtaagcagagttcagaaaaatcaaacagagaaacagaaaaaatagcctatgtcttttattgtaaaatacaatttcacccatacgtttcagaaatgcaaggaagcatttattgaagactgttgcaaaaaagtcaaaatgttgcaatagggaaaacggttgtcctacactctcctaaagccaaaggcagaagaatgtaagccctgctcggagttagggggatagttctggaggtcgttaggagggaagttgaccggtgtgattgggccatctgtgttggctaatttgtgcttattggagttaggcttttatcctcctacagagacatggctgctctacccttgcataattacatttatagggatgaggcatctgacttactcttttgttgtcctaccatacgagtggctcaaggtagaaaatctcttatacatcatcagtgaacctagactctatctgcatcccggggaacagttctggatctcatccaaggctgagcgagttgctcaggttgtttggagaccctcacatctctccctgcattctctgtccctagagtttgcagctgtcattgctcaccatagactgcagtagcagaagccacatgtggtgctcccagtgtgcctttatccacacagaggagcagggaggctctgtcctcatctgcccctttcccttggattgatggatgcttctaagcaaataggcccgaattctactccatccttctctgttgcaacagtaatttctctcatttcagtggagattgacctcctcttgcatatctcttgccctgatgctattctctccattgaacatgctgctctactcctttgttaagtgtctccaggttttaaatatctttatgcttaaccatacaattttttactgccactgcaagccaaaataatctcttttttcttctaaagtcctaatgcttcattaagccacatattgcccaagatatttttctgtatttctgcctttaatgttttgaatttgattcttaaaggtatgctattacaggaactagaaacaaggacagtcttaactgtgtagttttcaggtttattcgacagttttgtaataacaatgtgattttgtaatgatacgtgatgttagagattattaattagtttattcataatgaatgtattgatcccctatgatgtgttaggcaatcatctatgcactgtggtacgatgagccaaacatgcagtttcccttctagcataagaaggcaaatgttacagagagtcagtgaagtgtacagaaggtgagatggttataattctagagttagcaataaagagaaccagtgggatagaggtcaccagggggaacttgttgcaatttaaaattgagaaattgaggaagaacacagtgacaaagtgaaatttcagctgagaccccagagctggggagcaagccatgcagaatttttggtgaagtgcagatgccctgagatggagtcagcctggcccacatgacagtttaggagcacatacagagttagttcatgaccagaggactttgaatcagcggtagtgaaccagaaaccaaagaagggtgcacagccttcacaccctgaatcctattgggtccatcaccgtcactgtctaaacaacggggagagctgggaccattgtgtctatcagacccactgtgtcctccctgggatctgtattgggttccccagctgtgcagcatctcagtggggtgtgtggacccctgaactgcctcttcagacaggcagagcctcagtctggggctgacagctgcttagaatctgcatggggtggatgtgggcaacacctgctcccttctcctgggctctgggcatttgtggttggtgttggtggtcacagcagtgtctgggccatgagaggtcttagcctggaatggtgaataacccactagagacaccttcctttctttgaagcctgtaatctctgtcccactcaaactccttgcatcatcttaccagtgaccacccgctacgagtagccatggcttgaatatagtttctttttcaaacgtgttttaaattggccaactgcaactaccagatccagagtaaatacgaggggctcatgctggactcctgaaaatggtcatgtcctgaaaggccatttgtaggacatattggacaaggattcaagggtcagtgggaatcaggggagggaaagggaggacagacaggaggaaaggtcatgtcacgccccagcaagatgtcagtctggccctcagggacaccggggttacgcagtgaccctgtcctctcggaggggaggaggaagacaggatcaggaaggcgcagacccctcgtgtgctgtgcctggtggggaggctgcagttggaggcaggacatcagggggcgctgtggccttcccgacaaatgctctgagcatctcagagggctctcctggttcattccctttccccaggcctggtttcttgctcactcactgatgtgcaggatgttttgagtatcagagcctcagtgccctgcaacaacaacagggccgccaagctcctgatgaaatttatttcctctcttctcttttcccctgcgaagctgtattttccaaacagaatcagggtctcagtggctttaaggcaactcaagagagtgcgtgttgcaaagtgcagtggagcatttgtgtgtgtgtgtgttttctgggtgtgaagacaactttgtgggtgtgaaatccaggtcttagtagacgtggctgtagggtgctcttaatgaggatatctcggtgtgggctgctgtgctttctgttccatgcatcccacctttgctaacaacccatttctctcttaatttaagttgtttcagtggatctcctgtaaccctacgtcttaaaaggcaaatgtgtgacctgaagatgttcaataaaactcccattctttagcacagaggatactgattttcctggagaagtaacgattttgtgactgcataaactttaagctgacactgagtgtttgcccagcacacaatggatccgaagaaaatgaggccgagtgaaaagccagaacagtgaacagtgagattggtggtgacactggaccttcatttcaacttaggtttgaagctcaaattcctgcttgaaattcctagaattatgaattatagtttgttcaaaaatttgatttaggtttcacgtacatgtatcccaaatgtgttgacacagacacataccacacgttaaagaggtgtaaacacaaaagtcttgttagaagacatttatttgggatgaggaaaggaaactgaggacagggtataggagtaacagcaattctctgtagctctgaagacaaattatgagctcgtttttctctcttccggaagctcagctgaagcagtatgggtagcgtactccaggagcactgcaagtccctctacggtgttctccaggactgtaggaatctcatctgcaggtgcaggtcaagcccctccttgagcctacagacacagagacagcatccaaaattgagcaccaaggtcagcagtgggtggtaaagggaatcttggagaagtcacatgctgagtgataggtgacgttggctgtattagggccggtagcacaaacagcctcagtcaataggaataaaaacacagtggagtgctggtgtcacaggatttgagactcactctcatttgctttcatttttgtgctccggccccatcacatacacacctgaacacactgttaggcccatcccgagtctttaaaagagattctctatcgacagagaaaaatattctcctaataattaagtctacttgtttagatccagaacgaactagttagtatgtctctctgtattttaaacatagtgaatttcacagacatatcttggaatgaagttttgggagaagaaaatctcttagatttctttggctctctactcaatttatagatgagaaaatcaaggcttagagatgctaagtggagccacctaagtgacatggaccattgagactcgattccagactctgtctcctgtctgtccctctagacactgcagctctgcatgccggcttgtcttacctgaaacctgaagaggagctctttcatcccatgcaaaggaatcaaccacttcctgatcatctgctccaggctgctcctgggctgtagcctcatcagcaattgcctggagtggctccgcccgagcctgcagggccaccaggagaatggcagcaaggagggcaaggctccttatggctggggtcacctggaggagagagagcaggagcggatgtgtggggagggaggagtctgcctagatttatagctgggagaaggctcagagacaaaccttcttgaaccttctcagtgagaggaggtggagattcgttggagagggtgtggatatccattggcttcaatgttcctcctttccttctctgctctcccagctttcattctagcatgcatctctatgttgagtgtcttggctgggttggagctgatggtgatgatgaggaccctgccatgatgatgtgctttcattcagtgaattcagggaataaaggcctcttactttctgaagatgggctctactgttctctggaagtctagacctggacccagtggagtagagaattaattcattgcaggctttgaaggcattaccaccctcatgaaggggtttttgaggttacgcggtgaggaatctgctgtaggggccagggtggagaggacaatgacctcatcaggctacaggtaaaacaagctcagtgacataaagagttgtctaaggctaaaaatgtctatgatttccatctctatttaggtgtgagtgacaaaaattatatatgtgtaatgtatactaccttatgagttgatatatgtatatatttggacctttatcttataccatgtagaaaaatcaagtccaaatgattagaagacctaaacatagacccgaaaccataaaatgatgagaggaacagatgaagataaagctttgacgttgatgtgggtaatgatttcttggctatgacaccaacgacacaggcaataaaggggaaaagacacaagtggagatgcactgaatgctaaaggatctgcacgtcagaaaacaaccaaacaatcaactgagtgaaaaggcaagccagaaaatgagagaaaatatttgcaaaccctacatgatagaaagggtaaatatctgaagacataaggaaatcaaacaactcaatagcaaaaaacaaataatctgattggaaaacagaccaatgacctgaatagacttctctcaaaagaatgttctaaagagctatgatcatgtctactggacatgtcaattaggacacgtgtgtttagaaggaaactgcttgagtttctctgttaacttagctggtagccaatgcccccagcagccaccagaggttcagacagatgttcacagcaggggattcacctgctgggcccctctggggtggcctgggagtcacagttcagattgggggcacagcctcaatgttgaaacctcaatgtgaaagtttaaattttgtgttacttacagatcctcaagctaggcagggtgagcagagagggcagacagcagtcctgtgttccaggtcttatgtagcaagagcatctgtgcacatcccagagaggacttcccctatttaaaggtctttggggatcaggtgtcctaatttccagggttattttctgttgggtacattaaataactctggtgacaaggacagttgaaaaacttggtgtgaagcttgggttcaaacaggcatcgacagagggacccctcacctaccttggtcagccctggccagacccagacagcaaccacctatggattctccatgactcctaagacaattgagcccacaatgcctatgctcgtggctgaggctgaactacctggaccgagggaatatttaaagccaccaggaaaggccagcgtgcatagcgtagtatacactctgtaaggagactaggaaaaaagcaccaacctacacactgaggagggtttaggattttgttctctatcagcctctgcaggccgtggggtctaaccgtaaaaacacatcaaagccattcagccaagcccgtagatgttggtgaacacctgggtgagactgaataccacttcggcttgtcttgctaagcagctcaggttttgctggactctcctgagttaagcaagtacacgtagcacgtggtgccctagaggagatagttatctccttgcttggcagttagatactttaaggctaaagaattttctaggagtaagagttaaagtgttttcagtaatcttaaggtggtatgaggcatctcaggtctctaggtgtgattgctgttctagagcactggggtcgctgtcactctgaggaagcagtgagtttctgatctctagcaggcccaggaatttcaccatttgaggaagtggccgtggtttcatcccagcagaggaacaaattagagctctttgaggaactgggaccaggagatggttttaggttctagggcattagtaggtgccctgtgagggcccagtggatgtgggtatagacagaaaatctgcaggggtgggcgtgtatgtggggaaggtccagtggttgtgggaacatccagtgacctgcagaagtcaaacctggaccagcctcctgcacacagaacactccaatccacaggcattttctcagtaacacatgagagaactattattgggagagctggttagatttgggtgtggagttgttacacacaggtctcagaagcccatattttttgcctaacttgtagggcagctccacgatctggcctagtcctttggttttttgctgttggagatatagctaatggggttactctgaaggcaaatggtgatctcacaaaataccatcgtattgggttatctgcagagtactcaacaaagcctgagctaaggaagcggtatggcaagggtcggggtatgtgccataaaccagcgtcatgtgctgggatagggagtgcagcagtaaggagtaaggagtatcctgtactagtaaggagaggctgctttgctggtgaccccacagtcaaggcaagtttccttggtgtctccaattccagcaaggccattgcctcccttgacgaccccttgggcaggggcgatgttgtctgaagccatggccattcccatggggatggccttcccaggtggccacccacgacgggaagtgggggtctgggcattcgctttactgctgctgttgcacaggctgttagccctgtgggtcttcagggaagcattcagcgaaagcttgagccgtgttttccttagtggtataggacgtttccatccacaactcttatacatcagagcacatgcatatcctggagcctgtgatcattttggaagctgtctttgcatgtgaggttccaatgtgcaagctgcagtctgggtttgtgctgtggcattgttagccggtttgaattcacacctggcattggcagggccacctgctggtttttttttttttttttttttttttagacggagtttcactcttgttgcccaggctggagtgcaatggcgcgatcttgggtcgccgccatctctgcctcctgggttcaagcgattctgctgcttcagcatactgagtagctgagattacaggcatacaccaccatgcccggcttattttgtatttttagtagagattgggtttctccatgttggtcaggctggtcttgaactcctgacctcaggtgatccgccaaccttggcctcccaaagtgctgggaatacaggcgtgagccacctgccggtctttaaaatgttatttgtgattgtgaaggctgctggtgtttaagctcaatgccaatggacccactcaatatctaagaattgagttgcctgccttggacggaggtcaggtggcatttgaggcacagcccccctagcatgggattccagcacttcccagctttccagtgtgggacacaagttctgaccagggcagtcctgttctagcagcttttggactttggatcctgagtctgacagtagctccacaagccatgggaacataagataccaagcaagaccaaccataaagagcactgagattttatcactcagggctttgatattgacatcgattatggtgtgagctttcaccaatgtttcttcagagtctttctccaccattgacacaggctacatttgggaatgatacttccatgtgatcatcagctaatgtagtctatgtccactagtctgaaggcttctgtttgtttagtgactcattctgtgccctttttgggtcttggagcaataatccctactacctccaggaaggggtgagtgggagacattagctaaatttcaaagtagtaagaactggagcttctgctggaagctgcacgtcaagatgggaggtgtggtatagcagaatcactgtggccctgctgggtaccagtgggcctgggctgccagtccttagggactcacagcttactatccatccacaatctgttttccagtaaatgtatgatgttgagacaatggacctcttatcacagtatgaggagttatcattattggagcaaatgtgaatgatgttatctgtaagggaaaatgaaccttactcttctgtgattaccaaagtgttcaccatggtgggcctggcctaattataatgaggcactggtggccacagggtagagagttaagaaagttaggactctcagaaggggcttggtccccttggggtttcatgccacaacttcaataagaatgactttaggaggccactgtgctgcttggggaggctggtggcttgggggcaatgggccaagtgagagtcccctaaaccctcatgctgtgatgcccattcctatgtcaccaccactgccttgaagtgggagcctaggtcttgatcaatgatattgggtggtttccgagagggaaatgtcacagagcaaatgtcacagcaagagagcacctgctacaccaagggtcttgggttggaagagttgatggaagtgcagggttgtgtgtctgcttctgcacgcaaaggtgctggctgtgtggtaggggcccagtgaagtcaatgtgctgaaaggttgatggcccaggaacaagggagtgccggccacagcctgtgttaaccacggcacggcatctgcagttgagcatcccttgcttggttggagatctggtgagaggcaccagtggcctagggtaccctctaaagtggccacagcctccagtgtctaaagttcgggggcgccactttggtttgagggccaggatgccattctctccactgcagatgctgctctacaccttcttctaatctattcacattttcaatatctcatgtttcaccatgaaattaaccactgaaaattcacattttcaatatctcatgtttcaccatgaaatcctttattgccactctaagacaaaatgatctctgtctttctcctgaagtcctaatgcttcatgaagccacattttacccaggatattgttctacatttcagacttcagtgtttttgatttgtttcttaaaggtttgctatcacaggcactagacacatggactgccttacctcagtaggtttcagttttttcctatatagtttagtgatgataatagaattctatataattacatgatattggttataattaatttatccataatgaatttgttgatcccctactatgtattaggcagttatctacgcactgtggtataacgataagcaaaacatgctgctcaccttctattgtagggagagaaatgttacagatggtaagtgaaacgtacagaaggtgagatagttacaattccacagttaggaataaagagaacaagagggatggaggccactaggggaacttgttgcaatttaaaattgagaaatcgagaaagacctcagtgacaaggtgaaattttagctgagacttcaggtctgggcaaccagctggtgcccttcggggtgcagtgcagatgccccgagatggagtcagctcggcccccatggcagtttggaacaatatggaaagtaacttatgatcgcatgattttgaatcagtggcagttcttagaaactaaggaaggctcctgcacttcaaacggtgaatcccaatatgtttccgtcactgtctcaacaagaggaagagctcagaccatttctctgtcacacacagacttactgtgtcttccctgggacctgtattgagttccccagctgtgcggtgtctcagaggggtgcctggactcctgagctgcctcttcagataggcagagcctcagtctggagccacgatctgctcagaatctgcatggggtgtgcgtaaaaacacctgcattcttctcctgggctctgggcatttgtcgttagtgttggtggtcacggcagtgtctgggccatgagacgatttagtcagaaatggtgaataacccacttgagacaccttcctttctttgaagcctgtaatttttctatcccagtcaaactccttaggacctcttaacagtgaccacctgctaagagtaggcatggtttgaatatagttttttttttttttcccaaacatgtgttttgaaatcactgactgcaactacacgatccagagtaaatatgaggggctcacactggactccccctctgggccggggggtcatgtcctgaaaggacatctgcaggacctattggacaaggattctagggtctgtgggaatcaggggagcgaaagagagaacagacaggtggaagggtcacgtctcatcccagcaagatgtcagcctggcctcaggtacaccagggttaggcagtgaccctgtcctcttgaagggaggaggaagacaggctcaggaaggtagaccccacgtgtgctgtgcctggtggggaggctgcagctggaggcaggacagcagggggcgctgtggccttcccgacaaatgctctgagcatctcagagggctctcctggttcattcccttttccccagacctggtttcttgctcactcactgaagtgcaggatgctttgggaattagaacctcagcgccctgcagcaccagcagggactcaggttacttggagaactctcgtccctctcttcatttttcctgatgccttagaagcagtattttccaggcagaaccagattttctgcagctttaaggtaacccaagagagtgcctgtcacccagtgcagtggagcaattgtgtgtgcgcattttctatgtgtgcagacaactttgtgtgtatgaaatctagattctggtggatatggctggaaaatactcttaatgaggacatcccagaggggtgcctctgtgctttctgttctactcatcacgtctttgtaacagccagttccactttaattgaattctttttttcccatggagctgattccatgtcaggtctaaaaagcagatgtacgatccagaactgctcagggaaactcaaacacttctggaaagaacgtgctggcttttcctgaggagtagcagtgttatggctgtataagcttgaagctgacaatgatggtttatggaacacgtaagcattatctttgcatgaatccaatcaaaatgaggcagagtgaaaaggcagagcagtagatggggagatgagcagcatcatttgagctttcctaacaatgtgtgtctgaagcctttgttcatctccaatattcctagaattggaactggcttttgtttaacatgtagaatttagtgttctggtacttgcatcccatggtcttgactaagacacatatcaaacattaaagaggtgcaaacacaaaacttgctacaaggactttacgagagatgaggaaaggaagctggagaccaagtacagtagtaatgaaagttatcttctatgtctgaaagctagttatgaacttactttcttctgttccacaagctcagaggaagcagaatttgtagtgaatctcaccggaggtgcaggttccatagttgcgttcttgaagatgataatctcttattctgcaagagcatctcaagagggttcttgggcctggggatacagagagcatcaggcattaggactggggtcagatgtgggtggtagacagaatccccgtgcagttacctgctgggctgattgcgttaatcacagtggccacatcagagcagcagcaagatcagctgaatcagtaggaatcaatgtacacagcagtgctgctcacaggcaggattagagacgcattctcatttgctcacctttttgtagtcctgctccatcaccaaggcatctgatcacactcataggcctcttgctagtttctaaaactcttctaatagacaaagtgaaacatgtttcttcaagagtgggctctcatcaatgatgcagggaagatggcccagtatgtttctgcagagcataaaataagtgtgcttctcagaattgtcatagactcaaaaatcttcggagaaaagtcatccctggagtatcatctggttctttccttttagtctacacatgaggaaattgaggcctagggaggtgatcacctaagagaaagagccagctgttgggtctgattctagaggtgcctggttttcctctctagactcctagctctgcaatgctggcggctctcacctgaagctctaaaacctgagcttgtgtccccagtgaaggagatggtaaagtcctggtcgtctgccccaagctgttcctgggctgcagcctagtcagctcttgcctggagtggctcagacagggcctggaggggcaccaggagaatggcagtgaggagggtgagggtcctcatggctggggtcatctggaggagggatagcaggaggggatgtgtggggagtgaggagcaagcctggatttatagctctactgggagaaggcctgagacagatgctgcagtgacaggaggtggagcttgtgattggttgtggcagggctacccttgccctccaggtcccttttgtgttctggtgttttcccagctttcatcatagcttgaggctttatgtttagtgtctggactggatccaagctgatagtgaggctgagtacccttatttatttttctgtttacaatctacttgaatattttctttttgatattgaaaaatgtaaagaaaccgtgatttcattcattaagttggggaacaaatgcctcttattttctgaagatgggccctgccactgtctggagccccagatctgaacccagtggcatagaaaattaaagcagtggagaattcagggacatttccaccctcatgaagaggttatagggtgtgtagcctcctcctggggctggtgtgaggacaaaaagacttaatcaggctacaggtgaaatgagctcattaggatactaggtcaagaataagtaaaactaaagccaaatggtgggttaattttaagaaacaaatgtcatttggacagatcaggtaaaatttctatcattaacatatctgtactttaagaaatatcgaaacaattgacatgcctatagccctcttctaggatctttgtgattgttttaattataaaatcttaaatcatgcagacggaacaacaggtagaaagggtaataggctcccgtctgttcccccagccctgcagctctgctcttggaaaccaccacttcccaattttacacattcttccacacttgctttttccctctaatgctgtgtcttgtacactttgtatatcaaacacatcgagcttcaacgttacaattattccctatacttttccagcgttcgcacatgccatcactttactatttttatactgggaaaatattgtcaagttgtcataatttgtatatttctaagctttgccatgacaattttaaacagcaatgaatataattttatagacatcagtttgcccataagtgacaatatcttttgaatatgtctttagaagtagaattctgggttaaagaacatgtcttaaatattttgagtttattgttacattgtcctcactaaagattgttcaatacactaaaaacaaaaatcactccaaccatcactgagcccagtggaatttcttttagaaggccctgttttgtgcaaacgtagttccagtttttgcattgttgaaatttgccgtttgatattggaatacattcttaaataaatgtggttatattatagaccattttaatgcacattgctcactttattttttttttgctaatgacttattagtttctgtctattttatatttattttacactatggaaatgatgttagacaaaaagcaaattccagcaattttcttagttgaattcaaaataagtcgtaaggcagtggagacaactctcaacatcaacaatgcctttggtccaggacattgcattttggcccactgcactagccaacttacagtgcagtggtggttctggaagttctgcaaaggagacgagacccttgaagatgaggagcatagtggcctgccattggaagttgacgacaaccaattgagaacaatcattgaagctgatctgcttacaactacataaaaagttgccaaagaattcgacatcaaccattctgcagttgtgcagcatttgaagcaaattggaaaggtgaaaaagctaaataagtgggtgcctcacgagctgacagaaaataaaaaaaacgtcgctttgaagtgtcgtcttctcttattctacgaaacaacaacgaaccatttcttgatcagattgtgatgtgcaacaaaaagtggatttcatatgataaccagcggagaccagctcaatggttggaccaagaagaagttccaaagtacttcccaaagccaaacttgcgccataaaaaggtcatggtcactgtttggtagtctgctgcctgtctgatccactactgattcagctttctgaatccccgagaaaccattacatctgagaaatatgctcagcaaatccatgatatgcatcaaaaactacaaaaactacaatgcctgcagccggcattgctgaacagaaagggcccaattcttatcaatgcaacacccaacagcatgtcacacaactaatgcttcaaaagctgaacaaattgggctacgaagctttacctcatctgccatattcacctgacctctcgccaaccgactaccacttctttcagcatctggacaactttttttgcaaggaaaatgcttccacaaccagcgggatgcagaaaatgttttccaagagttcattgaatccagaagcacggatttttatgccacaggaataaacaaacttatttcttgttggcaaaaatgtgttgattgtaatggtttctattttgattaacaaagctgtgttggagcctagttataatgatttaaaattcatgatccgaaactgcaattacttttgcaccaacctaatttttaccaattgtcattgccttttcttcctgcctatgtttagggcagcaatatgttcctctaggaatacttgacgtcttagactctcttgcagctcagtgacagctctgttctgagcaataaaagataatccctaagaggggtagtctttaaaataatgaaataaatttctgttttcctgttataattttccattattgttttatgtggtcttccttttttcttcttggatcgtggaagcacttggacttgcagaaacagctgtctttttaccatgaagaagacaattcctccatatggatggaggagcagaaagatacaagactgtttggttcttgaggccatggttgagatactgcacccactcctgtttgcccacctctggttgtgtcacgacttaggagaaacatgatctggcctttgaaatccactgtttatttgggtttcctggtctttgtggctgaaagcagctggtacttgcattatagagctttttaaatcttttctaaagtgataagcaaaatttgatatcacagtggagtcttggtttgcatttttcatgtaaattaggctcaagaggatttaatgcccaagaagcacttgtatttattttcactgaagtgcttttttttttttaaaccttcttggcctatttatttttattgactggtagcatctgtttatatagtttgaaattaacactttgtcatgggtattagaaatatttttagagtttgtcattctctatagggtttcttttgatgtgtagttatttttatgtagatttaaaatttatttgttgctttctgagttttgtgtctttcccacttaaccttgtaaaactcagtcttgcatgtgttcgttcatgctctgtgctatgagtcagggttgcctttccatctgctgccaccctccctgaggaggctgtgctgtcccaggtagggctatcaggatccataccaactggacatatgaatggcacatacagaggcccaacaagtgtgtaggaaacatggccgtagatgaagctgctagatcagagaaacatcaaagcgacattgtagcaacaaaggtgctctgtgtggtctgtttcacctcttctgtcccactgtgctgtgcctcagtcttccccaaagtacacacatttcattgtaagcacagaattccatttctgaaggcccttatctctgatcttgcacctgactgacttatacacacaggaagcccatgtctcttccctcctcagagacattcagatcctgcttctgcacaggaggggctggaccccaagatgaattgcagtcttgcggacctgttcttgctacaatctcatgcacctgtagaccctgatgggtgcatccagctggccatatcattatctccagtctgtggagaggtcaacagtactcctagctaccattttctgagagaaataagtctctttactcagtaatgatgatcaatgggaattctgactggtggcgtctggtaataaacttgacttcagctacttaaaggatgtggaccaaaatatcagatcccagatgcttcacatgaaatcccaaaggaggggctttacaaaggcttgagctgaggagagcctgtgatgctcatgtaagactctcagtcagcaaatatcccttgagcatcagcagctgtcaggttctaggctcagaacacaaataacccagcagcttacagaagccagcactgcagaattcagaggatagagagtatagggtatgaatgaagtatatggaatttggcatcggtcttgttgctcaataatttttgactttgattaaggtaaataatctgtctaatgttcattttctccttaatgtatatttctggaaaaaatatttaatggtaattgagagttagtaggattaatgtgagtattagttattataatggatggatatttcttagtaatcaattcatattagctaatattagtatattaaatctttttgtgttttgagaatactgtctggcctataggagttatccaattaatagcacttttatgatgtcagacaatgctgccttcaacccatcataaatgggaagaacatattagtgttctcattttacagaatactatagtttgatccataggattaaagtgttgcctccaaggataaaggtccagcatcgtcaaagctaggttggaatcccaggcccctttttccaaatcccttcatctgcttatggcatgggttcccaacccctgtgctgaggaccagtaccggtccatggcctgttaggaaccggggcacacagaaggaggtgagcgaacattaccgcctgagctctacctcctgtcagattaacggtgacattcgattcttataggaatgtggaccctattgtgaactgtgcactcgagggatctaggctgtgtgctccttatcagaatctaactaatgcctgatgatacgaggtagaatagtttcatccagaaacaatccctcagcccccccacccatggaaaaattgtcttacaactgtcattggtgccaaaaaacgtgtccccagtaagtgcctaactaaagtcaagtgacactgtggagcagtagaggcttcatgtccttcttgaagcaggacaggactggggcaaggagagaggtgagagattaagttccaagtgtggagaacagtgtgtagaggaaatgtatgaagacgttcagtaggacgctgtgtagactgtgctcactgaaggaaggttgtaaacatggggaatggcaagtgagtttagactggaaattgtggatgagaagattcctggagattttctagacacagcttcacatcttaaggatgagggcttaagaatagaagggggtgagtggaaatgaaactgccaagcacacttttctttgtgcttccatgccctgtagggattcagagcctcacaggggaagccctacaatgagacagggatgctatgtcttgggataatcacattgtgaaaacatggcccacctctgacttattctttatcgttcgatcacatgagtggattctttaaaatgcctagtaggtcttcagtgtacatacagagtttgtgttttcaataatcatttcgtggtcttatttgaggctgcgaaaattaccctggttgtctggagaccctcacatctctccctgcattctccgtccctagagtttgctgctttcattggccaccctggactgcagtagcagaagccacatgtggtgccccagttgaggacgatgggatgctccgtcctcatctgcccccttcccttggattgatggatacttctcaccatgtcggccggaattctgctctactcttctctgttgcaaaagcaattcctctaaattcactggaggtctatctgacccttcatacttcttgtcccaatgccattttctttacctagaatactgctctacctcttctttttaatgtattgaatttttcaatatcttgtatgtttcagttaaagatatatcataaactcttgtcttgccactacaggccaaaatggctagttcttcattagaaggtagtgatgcttcacaaagccattttctactcatgatattctcctgttggtttaaatgatttttattgatttttaaagcaatgctgtcacatggactaggcacatgggtgctttatccccataggtgtcaggtttattctacgaagttttgtaataacaatgtaattttgtaataatatgtgatgttagatatgactaattaatgtaatcataatgaatttgctgatcctctactatttattagggagtcgtctgtgtactgtggcccaacaatgagtaaaacttgcagctcaccttctagagtagggaggcaaacattacagaaagcaggtgaaatgtacagaatgtaagatggtgtgaaactctacagtttaaaataagagaagaaggggattgaggtttccagggggaactagttgcaatttaaaattgagaaatcagcaaagccctcagtgacaaagggaagttttagcagagactccaggatctggggtgcaagaaaggtggacttctgggtgaagtgcaaaagccgtgtgagggagtcagcccagcccagcggacagttaggagcagtatgcagagttaaagcaagcaccatgtgacttcaagtcagtggcagttataggaacccaaggaatgttgtctggccattgcattctcaatcttaatgtgtgtccttccttctctaaagaagaggtagagctgggaccatttatgtgtcagtcataggctcatctatagtccctaagatctgtattgagttccccagccatgcagcatctcagtggggtgcctggatccctgagctgccacttcagacaggcagagcctcagtctggggccgagacctgctcagaatctgcatgaggtggacgtggggaatgcctactccttcctcctggggtctgggcatttgtggttggtgttggtggcttccccatccatgcagtgtctcagtggggtgcctggacctctgagctgcctcagcaccctgcaacaacaagaaggctacgattttcccggtgaaatgctttccctccctcatcacttatcccctatgaagctgtattttccaggcagattcagttctcagaagctttaaggcaacacaagagagtgcctgttgcaaagtgcagtggagcatttgtgtgtgtgcattttctgggtgtgaagaagagtttatggatgtgaaatccaggtcttagtagacatggctggagggtgctcttaatgaggacatgccagtgtaagctgctgtgctttctgttccatgcatcccacctttgctaacaacacatttccctcttacagaaagttttttccgtggatctcatgtaaccctatgtcttaaaaggaaaatgtacaatctgacattgttcaatgaaactccaattctttagcacagaggatggtggttttcccggagaagtaatgattttgtgactgcatgaactttaagctgacaccgattgtttgcccagtacacgggagggagctctttgagtggatccagagaaaatgagacagagtgaaaagacagagcagtggatggggagattggtggtgtcatatgggccttcttttcaattagagtctgaagccaaaactcctgcttgaaattcctagaatttggaattttgttttgtttaaaaacttaggattctggtaggtgcatgccaagtgtcttgagacacaaagacacatcaaatgtgaaagagatgtaaagacagaaatcttgcgataaggtatttatttaggatgagaaaatgaaattaaggacaaggtacaggaataacaagaatttcttttactctcaaagtaaataatgagcttatttttcttgattctgcaagctcagcagcagcagatccggtataatctaccaggaagggcacaggacccaaagcgacgttgaaagaaatggcaaattcctcgtctgcaaatgcacctcaagcctctccctgagcctggggacacagggacagcatcagaaatggatcaccaaggtcaacagtgggttgtaaagggaatcttggagaagtcacgtgccagctgatgagtgatgttgtctgcattagggccggtagcatgaacaacctcagtcaataggaataaatacacagagcagtgctggtcacacaggatttgagactcattctcatttgctctcatttttgtgcttctgccccatcacacacacacctgaacacactcttaggcttggctctacttttaaaaaaccattctatagatacagtaaaatattctccttataatgaaatctacttgtttagatccagaaagaagtagtcagactgtctcttcatatcttaaacctactgagtttcacaggcatatcttggaatcaagtctttcctttttatttattttttctaaagtgaaaggattattaagaaagtaaaagagtaaaataatggctgctctccatgcagagcagccttaagtctttaaagacagaaaacctgttagatttattgggctctctcttcaatttatagatgagaataccaaggaccagagatgctaaatgaagccacctaagtgacatggaccattgagactcgattccagactctctctcccgtccaaccctctagactgtgcagctctctgcatgccggcctgtctcacctgaaagtggaagtgcagcgctttcatcccatgtaaaggaaacagacacttcctgatcatctgctccaggctactcctgggctgcagcttcatcagctcttgcccgaagtggctccgcctgagcctgcagggccacaaagagaacggtggcagtgaggagggcaagggtcctcatggctacagagacttggaggagggagagcaggagcagatgtgtggggagagaggagttagcctgggtttataggtctgcagagagaaggctcagagaccagaaactttgaaacttctcagtgagaggaggtgtgcatttcatcggggattgtgtgggatccctttggtctcagtgtccctcttttcctcctttgatctctcagcttttattgtagtgtgaatctctattcacactagaaagtgtgagtagatggatcaggtgtttggagaagatggtgaagatgaggatcctggcatgtttttcctgtttctcacttcattccatatttactttttaataaccaaaagataacagcagtgcttttgttcagtaagttcagggagcaaatgtgtcattttctgcagatggccccactacttcctggaggtctacactctggcagcaggcataaattcctatcaagtgaagagtcatttgttgcaggcatcaagggcgtgaccaccctcatgaagtcatggggttagtagtctcttgtaggagccagtgtgaagaggaccatgaccctatcacgtgataggtgaaatgaacacagtgacatcgaggtaaaaagttcatctacatccaaaagaaatttttccagctctactgagatatgaataagaattaaaaatggtacagatctactgtatactgcgttaggatttgatgttcatatacatgtggttttttatcatatactaggtacacaaatcaactcaaaatgttttgaagacccaaacatagacctgaaaccataaaatgatgagaggaacatatgaagataatgctttgacgttgatgttggtaatgatatctttgctatggcagcaaagacacaggcaatgaaaagaaaaatagacaagtggggctgcattgaacattaaagcatctgaatggcaaaaatcaaaaagacaaacaactgagtgaaaaagtgacccagaacatgagagaaaatatttgcaaaccctaagtggtagaaggggtaaatatccaaatacataagtaagtcaaacaactcaatagcaaataacaaataacctgattgaaaaacaggccaaggagcaggataggctcctctcaaaataaaataatgtttcaaggcgctactattgtctctgttagacacgtcaagtaggacacgcgtatttcgaaggaaatttcctgagtttctctattaacttagctggtagccaatgccccaggcaaccaccagaggttcagagagaaatgcacagcaggggattcacccactaggtccctctggggtggtccaggagtcacaggtcagactgggggcacaggctcaatgttgaaacctcaatgtgagagtttaaggtctgtgttaattacagctcctgaagttaggcagagtgaccagagagggcagacagcagtcctctgtccctggtctcctgtagcaagagcagccgtgcacaaacaggaggggacttccctatttaagggtgatttgggatcaggtatcctaatatcctgggttactttctgttgggtacattaaataactctggtggcaagggcagttgagaaatttggagggacgctgtggtgtagacatgagtccacagagaaccccgcatctaactcggtcagccctggccaggcccaggcagcaaccaatgatagattccatgactcctaagacaatggaccccgagatgcctgtgctgatggctcaggctgaggtaattgcacccagggaatacttaaagcccccaggagagcctggcctgcatatcacaggatacactctgttagggagacaagttacgacagacacccatgcacaggagaggatgaggaatcttgcctgaaccagcctcccaagtacctgtgctctaaccgtaacaacacatcaaagccgattggctgggttgggatgttgcagaccacctggttgagactgaatcccacgtcggcttgtgttaccaggcagggcaggttttgttgggtttgttaaggatgtgcacacagcatgtggttcccgggagcggacaattgcctcgttgcttgggcaatggacagtttaaggctaaacgagtgtctaggaccactggcgccaaggactcctgagtttcctgcttgagatctaatgtcttttggaagtctctcagggaggcggccaaggtggaagcaagatgggtgttagcttacatcacctggtgctgtgttctcaaataccttgctcttaagtcaattctgggcaggcttaagagcctccatacacacggcgtgagtgggaagatcactggtcactcgagatatgcaggattgagctcctgtggtccctcctgtgttatttcaggagaagtcctaggaaaactagagcacattttaaaatgtaccactatccaccctcctcctccttctcatagtgaggtagatgtgataaggtttctggaaatgagaaaagaaagcagtcactcgagaggcagtaaatacctatggtgaggttgctgaacccagtgtacaggccagacagcccctgctgccatgggaaggtcatgcacagcgctggtcccacaggctgggtgctcagggcctcccctgcagctctgtgtgcaggcagcaggcatcggccggtggaggcctgggggcagtggagtgagaactaaagcatctccctcaaccttaaggtagaggaggcatctcaagccttgctaggggcggtcactgtggcagagcagtggggtctcctgtccctctgaggaagcagtgaattcctgatgtgtggcaggcccaggaacttcagctttggaggaagtgagcaccagtctcaccccagcataagaagaaatttgggctctttggggaaactgaggctctggtgacagttttagcttccagggcattagtaggtgcctgtagggtcgcaatgatgaggttatagggactaaatatgaaggggtgtatatgagcgagaggaagatctctgggttctggaaatgtcccatgtcctgcggaagtgaaacctggacctgcttcctgcacacagagcacactccagtccacaggcatttccgcagcactgcatgagcgttatcactggagagctggtgagattcgggcgtggtattcttacacacagttctcccaagtccatagttttccgtagcttgtagggcagctttacaatctcactgaggctctatgggttccttgcaccataaagtaatgggcttattctgaaagcaaatggtgatctcagcaaaattccactctaatgaggtcatttttggggtaatcagcaaagcatgaggtcagggaagcagcaagtcaagggtttgggtactggccatgagccagcaccgtgtactggagatggcaaggtccgtgtttgtagcagtaaggaaaggctggttggtggtgatctcgtggtcaaagtgattttcctctacaagggacttaaacaaataagtaagcaaaaaagaaatgacccctttaaaatgcgtgccagggcatgaacagatacttctcaaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagttggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccggcatgatctgacgtcagtgcctcacagggtctcacccctgagccctgtcagagctgcagctgagccagcaccccctgccacctgttcacaagtgtcttgggcctgaggttttcagatcccagcagcacttctcctctgatgcctgtggagagagccacctcccaattgcaaatgtgtgaatgaagacctgatcatgttgttttaatccattaagtcttgtggtgtcttttcatagagccctagatgaacagagggcaattttcacagtattggtgacaaattggacttgtactttgtgtgtgtgtgtaaatctcagcttctctaaaatattgatgaaataggagagaactttctcaattgaatcccaaagtgtcacaaagagcccattgtggtgggggcatggaattgtggactctttggagtgactgaggaacccggtctcacccattcttagtttgaatttttcctgtggggagctggggtagtgtgggatccaggtggagtctcaacctctcccctcagtgacagactcagaagagggtgcggaactccagagctggctgaaacaacggagagagaagtaggggttttctcccggagatcagctatgaagtcccagggaggatgaccattattcacacgactgtcatctggggagagaccccaagttaagatcaagagaaaaaagcgggaaacaaaatggtaaagacaacaaggtaactcatgcctagagtccttggatcaggcattttatgaagccagaagcctttcttttcttttctttctttctttctttctttctttctttctttctttctttctttctttctttcttttttttcttttcttttcttttttttttttgaggcagagtgtagatctgtcacccacgctggagtgcagtggcgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctgagtaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgttctcatctggccctttcccttggattgatggatgcttctcagcacatcagcctgaattctactccgtccttctctctggcaacatccattcctctgaattcagtggaggtccaccctcatcctgcatagctcttgccctgatagcattctgtccaccaaacatttcattctacctcttcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagttttttcctatggaatttaggaataacaattaataaataattttatattgttatgtgctattagatgcaattagttaatgtaatcagaattaatttagtaaccccctactttatgttacagtcatccatgcactctggtacaacaataagcaaaacatgcagcttcccttctggagtaaggaggcaaatgttacgtttagtaagtgaagtgtacagggagtgagacggttgcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccatttcatagttcagaatactatggaaagttaattcggggaccacatgattccaagtccatggcagtcacaggaagccaaagaaggctcctgggcttcacaccgtgattccctatttgtgtccttcatcacctaaacaagaagaagtctgggatcattacccactctgtcctcccagggttcttggtgggcttccatatccatgcagtgtctcagtgggtacctgggcccctgggctgcctcagccccctgcagcaacaagaacgctaccatgttcctggtgaaatgctttccctcccttgtcccttatcccctctgaagctgtattttccaggcagaatcaggttctcagcagctttagggtaacacaagagggtgcgcgttgcaaagtgcggtggagcatttgtgtgtgtgtgttttctgggtgtgaagacaactttatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgattgtttgcccagcacacgcgagctctttgagagtggatccagagaaaatgaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcactcagaatttgagactcattctcctttgctctcatttttgcattcctgccccatcacacacacacctgaacatatcctcaggcttggctgcagtttttaaaagctcttctgtagatagagtaaaatgttctctttacaactaagtctacttgtttagatccagaaataactagtctgtctcttcatatctgaaacttagtgaatttcacagacgtttcttggaatcaagtctttggagaaataaagtttctcatgtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttataagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgattcactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaggcctctgggacagcctggctgcgtatcacagtatacgccctgcaaagagattgggataggaatgccacctgcacacagaggaggatttggaatgtgtttctaaagcagtgtcccgaggacctggggtctaaccataaaaactaatgaaagccatttggctgagctgggatgttggagaacacccaggtgagactgagtgctacctgggcttctgttgctatgtggaacagacatttttgggttctcctgagtactggatgtacacgcggcatgtggttccccagaggtgactatcacctgtttgcttggccaatgaacagtttaagcttaaacaattgtctaggatcatctgggccaagaactggtctgaggcattagccatcagggtgggagtggcctttccagatggccacccaagaaaggaggtgggagtctgggcattcactttactgctggtgttgcacagcctctcaggccttgtgggccttcagagaagcattcagcaaaagcttgagtggtgctttctgggaggcataggagtttccatccttcactggtacacatcggagaacaggtgtatccctgagcccatgatcatgtctggatgctttctgtgaatgcaatgctccaactcttcaggctgcagtctgggtgtgtgctgcggcgtcatgagcccatttggattgaagcctgtgcatccagagaactacctcctcatccttaaaacacgatctgtggttgtgagggctgctggtgtttaagcattggtgccatgggacccattcaatatctaagggttgagttgcccgccttggacacaggtcaggttgtatctggggtgcagcccctgtaacagggcttacagggaattccccagttttccagtctggggtacaaattctgactagggctgtcctgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccctacttcctgccaggagaagtaagtgggaaatattagctaacctttaaaaccggtaaaaaagggagcttttgccagaagctgcatgtgaaatggagaggtgtggtctaacaaaagcctcgtggtcctgctgggtgccagtgggcctggggggttatcctcagaagatcgtagtttactatccatccacagtccattgttcagtatatgtttgatgttgagatggtggatgtcctgtgatgatatggggaggtctcattattggagaacatgtaaatgatgttatctgtaagggaaaaaagaagctaactcttctgtgatcaccaagataggcaccaaagtgcgtctagcccaattgtgatgaggcagtggtggccatgggattgagagttaaaaaagtgacggcccttggaaggaccttggtgccttgggtgtccatagcacatccagagacattaataaccatgactttaggaggccaccgtgctgcttgaggaggctggtggcttggggacgatggactaaatgagactcccttaacccaccctcatgttgtgatgtcctgaggtgggagcctccatctgaatcaatgataggtgtggttctaaaggagatagtgaagaaatgccacgtaaagagaacacctgctccacgcagggcataaggagctacggtccctggaagactacatgtgcagaagctcatagttaggacaggtgtgctttgtccagaggctctgagacttatgatgggtggtagtgagggcctccccatgaaactcagaacccgggacccgggcatggactagagagatcacctgctggaccagcaacagactgtatcctgctgtggccccagtggatgtgaagggcttctgggtgatggcatttgtgggcctcagcagaatggacaagtggggtatagctgtctccaaagacacgatgtcccagtacatggagggccagctgcaaagtggctaggacactagtggtgaggatttggtttttaactgcaaggggactttgtcagcccactgatgacaaattgatgcccagaatctttacaacagtgctggaggggccatgagtgtgtcctccagaaacgtggccactgtccaggaagagggagagcgggtgcagcagctctgccacagacatatgtcctggcccaggcggtggctttacatgcagcacccagagcgatttggggagctgagggagaacagagaccctccagctggctcagagtcactggtggctcctgtccctggaggggtggccttctctgccccaacccagtcttgtgctctccttccctgccattcttggctgcaggactgggaaccatctgctgggacgttgctctgtgtctccctcatggccatgctcccatccttgcctcctccatagactgcggtcaggactcagcagcccagagccccagcagggtctcagtctgtactgaggtcacacctaggcattgtcgccatccttcggcaggtgattctcaaactccaaactcaaattagaacagagagattcttccctgtggtccttttcacttttctcttttggctgcaccagaaccttggcagaattttgtggtttaaacaaaaaaggtgttatgcctacagattttttacagtactttcacttccatgttgatccatagtccccaaccccagcctgatgttttccactgattgcagccagtgtagacaatcagtgtccacactgtggacactatatgtagatgcagctgaagctgtttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggcctcagcagacacagtgtgtgtggaccttgggcggggccctggggttatggttttgacccggtaggaaagggtagtcatggaacacagcatgcgtgttaccatggggcgcagcgggggctacgcagaggtgagctctgaggaggaccctccacctcccagctcctcagagtgcatcgcgctgtccctcccctcagccctttgtccactgtcctgcagggagggtcctggtgctgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatggccctaaatccctgactcttttcacataaaaatggaggtgaaaatggctcctgttgaatctagattgggcgacatcttgaccagttgaacacacctgacttagcaccgtgctgtttgttgggctaaggtcataagaagttggtatctttcacttcctgagtattggatggtgctgcagcctgaatgtttctgtccctctgaaattcatatgttgaaatccctcctctggtgacagcatgaaaaggtggggctttctgggaagtgatatgttcaggaggatggagtcctcatgagttgcattagtgcccctgaggaagaagccccagagagctccttcattcattccctcaggtgaggaagcagtgagaaggtagcatctatgaaccaaaaagctggtcctcaccacacaccaaatctgttggcaccttgatttggacatctcagcctccagaacactgagaaatgtatttttgttgtttataagtcacttggtgtatgattttctttcccccagcatcccacatatactaagagtgctggtgcctttgaagcccagctacaatgcttggaggaagtctaagcattgcaaaaaaaggaactgaacccacctgcaaggaagagctagagaacccagagcaaccagctttctaggaaaaacaaaactctgatatgcagtgtttgtaaatctctctggttcaaatcctcctagctatgagtgggataaaaagtgtcacacctatcttttctctcatgagctggcatgacctggcctcagtgcatcacagtatctcatccctcagcctgtcagagctcccactgagccagcccagcactccccgctacctgtgcgcaagcgtcttggccctgaggttttcagctcccagcagaacctgtcctctgttgcccatggaggggggctatgtcccaattgcaaatgtgtgaatgacgacctgatcgtgctgttttaattccctaagttttgtggtgtcttttcacacagccctagatgaacagagggcattttcacagtattgctgaggaattggatttgtacatattttgtgtgtgtaaatctcaacttctctgaaatattgataaaataggagggaattttctcaacttcttcccaaagcgtcacaaagagcccatcatggtgggggatgaaactgtggactctatggagtgactgaggaaccctgtctcatccattcttagtttgaatttttcctgtgtggaggaggggtagtggatccaggtggagtctcaatctctccactgagggacagactcagaggagggcatgggactcgggagttgactgaaacaatggagaaatcaataggggttttctcccggatatcaacaacggaggctgtggggagataaccacaattcatgtggctgtcacttggggagcgagcccaagttatcaagagaaaaatgggggtgataaaaggtaaagacaagaaggactcttatgctttgggtccttcaatcagggattttatgaagccagaattctttcataagtatcaggtgtggcagtcaaattgttcactcagtttgttgtggtttcttaaatttgaatgcaaaactcagctaatatgcctgaaaattatataaaaatattacctagctcagagaatctgagttaaagacagtacagttcataagaacaggaaacgagggtagatgacaggtgttcctggtgcagcctggggaacagactcccgggtgattcccaggcacgtttctgtgggagaacagccttatcgatgctgatcagcagggaaggagggatggctaccggagaggctggaagtacagcgggtgagtcagcaacagggaccttcatacttgatattcagagatgcaggaattccaggtggtggcaggagcatggggtggagggctggaacaaaagtgggggtcgctgtcagccaggaggatccagcacagagaggttgggagggtgactgagaggaaatgtgagagtgggctctttcccttaggttcttcatgagttgtttgtttcttagtgaaaaaggaaaaatttcagatactcataaaatggaatgagtacttttcagatccctttccttctggttttgcttgtaagccgagtttagaaaatcagaaaagaaatagccaaagaaaactatttcatttattgtacaagaaaaaattcaccaagacgtcgcagaaatgtgaaggaagcgcttattgaagactggtgaaataggagtcagaacgttgcaatagggagagccgttggcctcaacttccctgaagacaaaggcaggaaaggtgaaaccctgggtgagctaggggaaatgcactggaggttggcacccactctgtcctccttgggatctgcatgggcttccccatccatgcagtgtctcagtggggtgcctggacccctgagctgcctcagcaccctgcagcaacaagaaggctacccttttcctggtgaagtgctttcccggcctcatcccttatcccctctgaagctgtattttccaggcagaatcagattctcagcggctttaaggcaacagaggagagtgcgtcttgcaaagtgtagtggagcatttgtgcttgtgtgttttctgggtgtgaagacaactttatgggtgtgaaatccaggtcttagtagacctggctggagggtgcttttaatgtggacatcccagtgtgggccgctgtgctttctgttccatgcatcccgcctttgctaacaacccatttccctcttgaagttgtttcagtgaatctcctgtaacccaatggtttaaaaggcaaatgtgtgacctggacacgttcaataaaaccccagttctttgggacagatgatgctggtttctcctgaggaggaatgattttgtgactgcgtgaactttaagctgacactgattatttgcccagcacacgggagctctttgagagtggatccagagaaaatgaggcagagtgaaaagacagagcagtggatggggagatgggtggtatgatttgggccttcatttccatttgagtctgaagctcaaacgcctgcttgaaattcctagaatttcaaattttattttgtttaaaaacttaggattctggtaagtgcatcccaagtgtcttgagacacaaagacacatcaaatgtgaaagagatgtaaagagagaaatcttgcaacaaggtatttattttggatgagaaaaggaaatggaggacaaggtacaggagtaacaagaatttcttttaactctcaaagtaaattctgagcttatgtttcttgattctgcaagctcagcggcagcagatccggtggagtgtaccacgaaaggcgcaggacccaaagcgacgttataacaaacggcaaattcctcttccgcaaatgcacctcaagcctctcgctgagtctgaggacacagggaaatcatcataaatggatcagaaggtcagcagtgatggtaaagggaatcttggataagtcatgtgctaggtaatgagtgatgttggctgcattggggccagcagcatgaacagcctcagtcaataggaataaatacacagagcagtgctggtcacacaggatttgagactcattctcatttgagctcatttttgtgcttctgccccgtcacacacacagctgaacacactcttgggcttggctctactttttaaaaactattctacagatacagtaaaatattctccttgtaatgaagtctacttgtgtgaatccagaaagaacgagtcagactgtctcttcatatctaaaacctactgaatttcacagacatatcttgacgtcaagttttatttttcaattttatagattttctaaagtgaaaggattgttaaggaagtaaaggaataaaagaatggttactctccaggcagagcagcctcaagtctttaaagacagaaagatttatttggctctctattcaatttatagatgagaaaaccaaggcccagagatgctaaatgaagcccccgaagtgacatggaccattgagactcgattccacactctgtctcccatccatcccactagaccctgcagttctgcatgccggcctgtctcacctgaaagcggaagagcggcactttcatgccatgtaaaggcatgagccatttcctgatcatctgctccaggctgctcctgggctgcagcttcatcagctcttgcctgaagtggctctgcctgagcctacagggccaccaggagaagcatggcagtgaggagggcaaaggtcctcatggctggggtgacctggaggagggagagcaggagcagacgagtcgggagagaggagttagcctggatatataggtctgcagagagaaggctcggagacaagaaacctggaaccctctcagagaaaggaggtgtgcatttcgttggagactgtgtgggatcccgttggtctcaatgtccctgttttcttcctttgctctcccagctttcactctagtttgaatctctacgtgtagtgtttgtgctgggttggagaggatggtgacgacgaggatcctggcatgtttttcttgtttctcacttcattatatattgactttttactattctaccaaaggataacagcagtgcttttgttcgataagctcaggatacaaatgcctcttttcctgcagatggccccactactctgtacaggtctacactctggcagcaggcgtgaattcctatcaagtgaagagtcatttgttgcaggcatcaagggcgtgaccactctcatgaaggcatggggtgagtagcctcctgtaggggccagtgtgaagaggacaatgaccctatcaggcgataggtgacatgaacacagtgatattaaggcaaaaagttcgtctacagccaaaaatgtgtttctggctctattgagatatgaataagaatttaaaacggtatatatctcctgtataccaccttaggatttgatgttcatgtacatgtggttttttatcatatactatatacacaaatcaactcaaaatgatcgaagacccaaacatagacctgaaaccataaaatgacgagaggaacatatgaagataacgctttgtcattggtgtcgataacgatatctttgctatgacaccaaagacacaggcaataaacgggaaaatagacaaatggggctgcactgacctctaaagcatctgcacgtcaaaaaacaaaccaacaaacaaataatcaactgagtgaaaaagcaacccagaaaatgaaagacaataattgcaaaccctaggtggtagaaggggcaaatatctaaatacataaggaagtcaaacaactcaaaagcaaataacaagtaacctgtttgaaaaacaggccaaggagcaggataggcttctctccaaataaaaggatgttctaaggagctattgttgtctgtattggacgtgtcaagtaggacacgtagatttagaaggaaattccttgaggttctctattaattgagccggtagctaaagctcccagcagccaccagaggttcagagagaaatgcgcagcaagagattcacccacaaggtccctctggggtggcccaggagtcagaggtcagactgggggcacaggttcaatgttgaaacctcaatgtgaaagttttaagtcttgggttacttacagatcctcaaggtaggcagagtgaagagggagggcagacagcagtcctctgtcccgggtctcctgtagcaagagcagccgtgcacaaacaggagaggacttccctatttaagagtcatttgggatcaggtgtcctaataacctgggttactttccattgggtttattaaataactctggtgggaaggacagttgagaaatttgatgggaagctggggttcggacaggagtccatggagggtcccctcatctgcctttgtcaaccttgcccaggcccaggcagcaaccaacgatggattctccatgactcctaacacaatggaccccgagatgcctgtgctggtggctgatgctgagctagttgcagcaagggaatatttaaagcccccaggagagcctggcctgcatatcacaggacacactctgttagagagacaagttcaagtttgacacccatgcacaggagaggatgaggaatcttcccctgaaccagcctgcccagtacctgagctctaaccataacaagacaccaaagccgattggtgggctgggatgttgcagaccacctggttgagactgaatcccacgtgggcttgtgttagcaggcagggcaggttttgctgggttcgttaaggatgtgcacatagtatgtggttccctggagtggacaattgcctcattgcttgggcaatggacagtttaaggccaaacgagtgtctaggaccactggggccaagaactcctgagtttcctgctggagacctaatgtctcttgaaagtctctcagggaggcggccaaggtggcagtgagtttggtgttagcttgcatcacctggtgctctgtgctccaatgccttgctcttaagcccattctgggcaggcttaagagtctccatgcacatagcatgagtgggatgatcagtggtcgcttgaaatatgcaggatcaaactcctgtggttcctcctgtgttatttgaggagaattcctaagaagactagagcacattttaaaatgtaccactatccaccgtcctcctccttctcctagtcaggtagatggggtaaggtttctggagatgagaaaagaatgcagtcgctcgagaggcaataaatacctgtggtgaggttgctgaacccagtgtgcacgccgggcagcccctgccaccatgggaatgtcgtgcacagcgctggtcccacaggctgggtgctcagggccccccctgcagctctgtgtgaaggcagcaggcatcggccggtggaggcctgggggcagtggagtgataactaaagcatctccctcaaccttaaggtagaagaggcatctcaagctttgctagaggcggtcgctgtggcagagcagtggggtctcctgtccctctgaggaagcagtgaattcctgatgtgtggcaggcccaggaacttcagctttggaggaagtgagcaccagtctcaccccagcataagaagaaatttgggctcttcggggaaactgaggctctggtgacagttttagcttccagggcattagtaggtgcctgtagggtcgcaatgatgaggttatagggactaaatatgaaggggtgtatatgagcgagaggaagatctccgggttctggaaatgtcccatgtcctgcggaagtgaaacctggacctgcttcctgcacacagagcacactccagtccacaggcatttccacagcactgcatgagcgttatcactggagagctggtgagattcgggcgtggtattcttacacatagttctcccaagtctatagttttccgtagcttgtagggcagctttacaatctcactgaggctctatgggttccttgcaccataaagtaatgggcttattctgaaagcaaatggtgatctcagcaaaattccactctaatgaggtcatttttggtgtaatcagcaaagcatgaggtcagggaagcagcaagtcaagggtttgggtactggccatgagccagcaccatgtactggagatggcgaggtccgtatttgtagcagtaaggaaaggctggttggtggtgatctcgtggtcaaagtgattttcctctacaagggacttaaacaaataagtaagcaaaaaagaaatgagccctttaaaatgcgtgccagggcatgaacagatacttctcaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagtgggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccagcatgatctgacgtcagtgcctcacagggtctcatccctgagccctgtcagagctgcagctgagccagcaccccctgccacctgttcacaagtgtcttgggcctgaggttttcagatcccagcagcacttctcctctgatgcctgtggagagagccacctcccaattgcaaaagtgtgaatgaagacctgatcatgttgttttaatccattaagtcttgtggtgtcttttcatagagccctagatgaacagagggcaattttcacagtattggtgacaaattggacttgtactttgtgtgtgtaaatctcagcttctctaaaatattgatgaaataggagagaactttctcaattgaatcccaaagtgtcacaaagagcccattgtggtgggggcatggaattgtggactctttggagagactgaggaaccccgtctcacccattcttagtttgaatttttcctgtggggagctggggtagtgtgggatccaggtggagtctcaacctctcccctcagtgacagactcagaggagggtgtggaactccagagctggctgaaacaacggagagagaagtaggggttttctcccggagatcagctatgaagtcccagggaagatgaccattattcacacggctgtcatctggggagagaccccaagttaagatcaagagaaaaaagcgggaaacaaaatggtaaagacaacaaggtaactcatgcctagagtccttggatcaggcattttatgaagccagaagtctttcttttcttttctttctttctttcttttttttcttttctttttttttttttttttttgaggcagagtgtagatctgtcacccacgctggagtgcagtggtgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctaagcaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgtcctcatctgcccctttcccttgagttgatggatgcctctcagcacatcagcatgaattctactccgtccttctctctggcaacatccattcctctgaattcagtggaggtccaccctcatcctgcatagctcttgccctgatagcattctgtccaccaaacatttcattctacctctgcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagttttttcctatggaatttaggaataacaattaataaataattttatattgttatgtgctattagatgcaattagttaatgtaatcagaattaatttagtaaccccctactttatgttacagtcatccatgcactctggtacaacaataagcaaaacatgcagcttcccttctggagtaaggaggcaaatgttacgtttagtaagtgaagtgtacagggagtgagacggttgcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccatttcatagttcagaatactatggaaagttaattcggggaccacatgattccaagtccgtggcagtcacaggaagccaaagaaggctcctgggcttcacaccgtgattccctatttgtgtccttcatcacctaaacaagaagaagtctgggatcattacccactctgtcctcccagggttcttggtgggcttccatatccatgcagtgtctcagtgggtacctgggcccctgggctgcctcagccccctgcagcaacaagaacgctaccatgttcctggtgaaatgctttccctcccttgtcccttatcccctctgaagctgtattttccaggcagaatcaggttctcagcagctttagggtaacacaagagggtgcgcgttgcaaagtgcggtggagcatttgtgtgtgtgtgttttctgggtgtgaagacaactttatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgattgtttgcccagcacacgcgagctctttgagagtggatccagagaaaatgaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcactcagaatttgagactcattctcctttgctctcatttttgcattcctgccccatcacacacacacctgaacatatcctcaggcttggctgcagtttttaaaagctcttctgtagatagagtaaaatgttctctttacaactaagtctacttgtttagatccagaaataactagtctgtctcttcatatctgaaacttagtgaatttcacagacgtttcttggaatcaagtctttggagaaataaagtttctcatgtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttataagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgattcactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaagcctctgggacagcctggctgcgtatcatagtatacaccctgcaaagagattgggataggaatgccacctacacacagaggaggatttggaatgtgtttctaaagcagtgtcccgaggacctggggtctaaccataaaaagcaatgaaagccatttggctgagctgggatgttggagaacacccaggtgagaatgagtgctacctgggcttctgttgctatgtggaacagacatttttgggttctcctgagtactggatgtacacgcggcatgtggttccccagaggtgactatcacctgtttgcttggccaatgaacagtttaagcttaaacaattgtctaggatcatctgggccaagaactggtctgaggcattagccatcagggtgggagtggcctttccagatggccacccaagaaaggaggtgggagtctgggcattcactttactgctggtgttgcacagcctctcaggccttgtgggccttcagagaagcattcagcaaaagcttgagtggtgctttctgggaggcataggagtttccatccttcactggtacacatcggagaacaggtgtatccctgagcccatgatcatgtctggatgctttctgtgaatgcaatgctccaactcttcaggctgcagtctgggtgtgtgctgcggcgtcatgagcccatttggattgaagcctgtgcatccagagaactacctcctcatccttaaaacacgatctgtggttgtgagggctgctggtgtttaagcattggtgccatgggacccattcaatatctaagggttgagttgcccgccttggacacaggtcaggttgtatctggggtgcagcccctgtaacagggcttacagggaattccccagttttccagtctggggtacaaattctgactagggctgtcctgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccctacttcctgccaggagaagtaagtgggaaatattagctaacctttaaaaccggtaaaaaagggagcttttgccagaagctgcatgtgaaatggagaggtgtggtctaacaaaagcctcgtggtcctgctgggtgccagtgggcctggggggttatcctcagaagatcgtagtttactatccatccacagtccattgttcagtatatgtttgatgttgagatggtggatgtcctgtgatgatatggggaggtctcattattggagaacatgtaaatgatgttatctgtaagggaaaaaagaagctaactcttctgtgatcaccaagataggcaccaaagtgcgtctagcccaattgtgatgaggcagtggtggccatgggattgagagttaaaaaagtgacggcccttggaaggaccttggtgccttgggtgtccatagcacatccagagacattaataaccatgactttaggaggccaccgtgctgcttgaggaggctggtggcttggggacgatggactaaatgagactcccttaacccaccctcgtgttgtgatgtcctgaggtgggagcctccatctgaatcaatgataggtgtggttctaaaggagatagtgaagaaatgccacgtaaagagaacacctgctccacgcagggcataaggagctacggtccctggaagactacatgtgcagaagctcatagttaggacaggtgtgctttgtccagaggctctgagacttatgatgggtggtagtgagggcctccccatgaaactcagaacccgggacccgggcatggactagagagatcacctgctggaccagcaacagactgtatcctgctgtggccccagtggatgtgaagggcttctgggtgatggcatttgtgggcctcagcagaatggacaagtggggtatagctgtctccaaagacacgatgtcccagtacatggagggccagctgcaaagtggctaggacactagtggtgaggatttggtttttaactgcaaggggactttgtcagcccactgatgacaaattgatgcccagaatctttacaacagtgctggaggggccatgagtgtgtcctccagaaacgtggccactgtccaggaagagggagagcgggtgcagcagctctgcccatatgtcctggcccaggcggtggctttacatgcagcacccagagcgatttggggagctgagggagaacagagaccctccagctggctcagagtcactggtggctcctgtccctggaggggtggccttctctgccccaacccagtcttgtgctctccttccctgccattcttggctgcaggactgggaaccatctgctgggacgttgctctgtgtctccctcatggccatgctcccatctttgcctcctccatagactgcggtcaggactcagcagcccagagccccagcagggtctcagtctgtactgaggtcacacctaggcattgtcgccatccttcggcaggtgattctcaaactccaaactcaaattagaacagagagattcttccctgtggtccttttcacttttctcttttggctgcaccagaaccttggcagaattttgtggtttaaacaaaaaaggtgttatgtctacagattttttacagtactttcacttccatgttgatccatagtccccaaccccagcctgatgttttccactgattgcagccagtgtagacaatcagtgtccacactgtggacactatatgtagatgcagctgaagctgtttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggccccagcagacacagtgtgtgtggaccttgggcggggccctggggttatggttttgacccggtaggaaagggtagtcatggaacacagcatgcgtgttaccatggggcgcagcgggggctacgcagaggtgagctctgaggaggaccctccacctcccagctcctcagagtgcatcgcgctgtccctcccctcagccctttgtccactgtcctgcagggagggtcctggtgctgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatggccctaaatccctgactcttttcacataaaaatggaggtgaaaatggctcctgttgaatctagattgggcgacatcttgaccagttgaacacacctgacttagcaccgtgctgtttgttgggctaaggtcataagaagttggtatctttcacttcctgagtattggatggtgctgcagcctgaatgtttttgtccctctgaaattcatatgttgaaatccctcctctggtgacagcatgaaaaggtggggctttctgggaagtgatatgttcaggaggatggagtcctcatgagttgcattagtgcccctgaggaagaagccccagagagctccttcattcattccctcaggtgaggaagcagtgagaaggtagcatctatgaaccaaaaagctggtcctcaccacacaccaaatctgttggcaccttgatttggacatctcagcctccagaacactgagaaatgtatttttgttgtttataagtcacttggtgtatgattttctttcccccagcatcccacatatactaagagtgctggtgcctttgaagcccagctacaatgcttggaggaagtctaagcattgcaaaaaaaggaactgaacccacctgcaaggaagagctagagaacccagagcaaccagctttctaggaaaaacaaaactctgatatgcagtgtttgtaaatctctctggttcaaatcctcctagctatgagtgggataaaaagtgtcacacctatcttttctctcatgagctggcatgacctggcctcagtgcatcacagtatctcatccctcagcctgtcagagctcccactgagccagcccagcactccccgctacctgtgcgcaagcgtcttggccctgaggttttcagctcccagcagaacctgtcctctgttgcccatggagggggctatgtcccaattgcaaatgtgtgaatgacgacctgatcgtgctgttttaattccctaagttttgtggtgtcttttcacacagccctagatgaacagagggcattttcacagtattgctgaggaattggatttgtacatattttgtgtgtgtaaatctcaacttctctgaaatattgataaaataggagggaattttctcaacttcttcccaaagcgtcacaaagagcccatcatggtgggggatgaaactgtggactctatggagtgactgaggaaccctgtctcatccattcttagtttgaatttttcctgtgtggaggaggggtagtggatccaggtggagtctcaatctctccactgagggacagactcagaggagggcatgggactcgggagttgactgaaacaatggagaaatcaataggggttttctcccggatatcaacaacggaggctgtggggagataaccacaattcatgtggctgtcacttggggagcgagcccaagttatcaagagaaaaatgggggtgataaaaggtaaagacaagaaggactcttatgctttgggtccttcaatcagggattttatgaagccagaattctttcataagtatcaggtgtggcagtcaaattgttcactcagtttgttgtggtttcttaaatttgaatgcaaaactcagctaatatgcctgaaaattatataaaaatattacctagctcagagaatctgagttaaagacagtacagttcataagaacaggaaacgagggtagatgacaggtgttcctggtgcagcctggggaacagactcccgggtgattcccaggcacgtttctgtgggagaacagccttatcgatgctgatcagcagggaaggagggatggctaccggagaggctggaagtacagcgggtgagtcagcaacagggaccttcatacttgatattcagagatgcaggaattccaggtggtggcaggagcatggggtggagggctggaacaaaagtgggggtcgctgtcagccaggaggatccagcacagagaggttgggagggtgactgagaggaaatgtgagagtgggctctttcccttaggttcttcatgagttgtttgtttcttagtgaaaaaggaaaaatttcagatactcataaaatggaatgagtacttttcagatccctttccttctggttttgcttgtaagccgagtttagaaaatcagaaaagaaatagccaaagaaaactatttcatttattgtacaagaaaaaattcaccaagacgtcgcagaaatgtgaaggaagcgcttattgaagactggtgaaataggagtcagaacgttgcaatagggagagccgttggcctcaacttccctgaagacaaaggcaggaaaggtgaaaccctgggtgagctaggggaaatgcactggaggttggcacccactctgtcctccttgggatctgcatgggcttcccatccatgcagtgtctcagtggggtgcctggacccctgagctgcctcagcaccctgcagcaacaagaaggctacccttttcctggtgaagtgctttcccggcctcatcccttatcccctctgaagctgtattttccaggcagaatcagattctcagcggctttaaggcaacagaggagagtgcgtcttgcaaagtgtagtggagcatttgtgcttgtgtgttttctgggtgtgaagacaactttatgggtgtgaaatccaggtcttagtagacctggctggagggtgcttttaatgtggacatcccagtgtgggccgctgtgctttctgttccatgcatcccgcctttgctaacaacccatttccctcttgaagttgtttcagtgaatctcctgtaacccaatggtttaaaaggcaaatgtgtgacctggacacgttcaataaaaccccagttctttgggacagatgatgctggtttctcctgaggaggaatgattttgtgactgcgtgaactttaagctgacactgattatttgcccagcacacgggagctctttgagagtggatccagagaaaatgaggcagagtgaaaagacagagcagtggatggggagatgggtggtatgatttgggccttcatttccatttgagtctgaagctcaaacgcctgcttgaaattcctagaatttcaaattttattttgtttaaaaacttaggattctggtaagtgcatcccaagtgtcttgagacacaaagacacatcaaatgtgaaagagatgtaaagagagaaatcttgcaacaaggtatttattttggatgagaaaaggaaatggaggacaaggtacaggagtaacaagaatttcttttaactctcaaagtaaattctgagcttatgtttcttgattctgcaagctcagcggcagcagatccggtggagtgtaccacgaaaggcgcaggacccaaagcgacgttataacaaacggcaaattcctcttccgcaaatgcacctcaagcctctcgctgagtctgaggacacagggaaatcatcataaatggatcagaaggtcagcagtgatggtaaagggaatcttggataagtcatgtgctaggtaatgagtgatgttggctgcattggggccagcagcatgaacagcctcagtcaataggaataaatacacagagcagtgctggtcacacaggatttgagactcattctcatttgagctcatttttgtgcttctgccccgtcacacacacagctgaacacactcttgggcttggctctactttttaaaaactattctacagatacagtaaaatattctccttgtaatgaagtctacttgtgtgaatccagaaagaacgagtcagactgtctcttcatatctaaaacctactgaatttcacagacatatcttgacgtcaagttttatttttcaattttatagattttctaaagtgaaaggattgttaaggaagtaaaggaataaaagaatggttactctccaggcagagcagcctcaagtctttaaagacagaaagatttatttggctctctattcaatttatagatgagaaaaccaaggcccagagatgctaaatgaagcccccgaagtgacatggaccattgagactcgattccacactctgtctcccatccatcccactagaccctgcagttctgcatgccggcctgtctcacctgaaagcggaagagcggcactttcatgccatgtaaaggcatgagccatttcctgatcatctgctccaggctgctcctgggctgcagcttcatcagctcttgcctgaagtggctctgcctgagcctacagggccaccaggagaagcatggcagtgaggagggcaaaggtcctcatggctggggtgacctggaggagggagagcaggagcagacgagtcgggagagaggagttagcctggatatataggtctgcagagagaaggctcggagacaagaaacctggaaccctctcagagaaaggaggtgtgcatttcgttggagactgtgtgggatcccgttggtctcaatgtccctgttttcttcctttgctctcccagctttcactctagtttgaatctctacgtgtagtgtttgtgctgggttggagaggatggtgacgacgaggatcctggcatgtttttcttgtttctcacttcattatatattgactttttactattctaccaaaggataacagcagtgcttttgttcgataagctcaggatacaaatgcctcttttcctgcagatggccccactactctgtacaggtctacactctggcagcaggcgtgaattcctatcaagtgaagagtcatttgttgcaggcatcaagggcgtgaccactctcatgaaggcatggggtgagtagcctcctgtaggggccagtgtgaagaggacaatgaccctatcaggcgataggtgacatgaacacagtgatattaaggcaaaaagttcgtctacagccaaaaatgtgtttctggctctattgagatatgaataagaatttaaaacggtatatatctcctgtataccaccttaggatttgatgttcatgtacatgtggttttttatcatatactatatacacaaatcaactcaaaatgatcgaagacccaaacatagacctgaaaccataaaatgacgagaggaacatatgaagataacgctttgtcattggtgtcgataacgatatctttgctatgacaccaaagacacaggcaataaacgggaaaatagacaaatggggctgcactgacctctaaagcatctgcacgtcaaaaaacaaaccaacaaacaaataatcaactgagtgaaaaagcaacccagaaaatgaaagacaataattgcaaaccctaggtggtagaaggggcaaatatctaaatacataaggaagtcaaacaactcaaaagcaaataacaagtaacctgtttgaaaaacaggccaaggagcaggataggcttctctccaaataaaaggatgttctaaggagctattgttgtctgtattggacgtgtcaagtaggacacgtagatttagaaggaaattccttgaggttctctattaattgagccggtagctaaagctcccagcagccaccagaggttcagagagaaatgcgcagcaagagattcacccacaaggtccctctggggtggcccaggagtcagaggtcagactgggggcacaggttcaatgttgaaacctcaatgtgaaagttttaagtcttgggttacttacagatcctcaaggtaggcagagtgaagagggagggcagacagcagtcctctgtcccgggtctcctgtagcaagagcagccgtgcacaaacaggagaggacttccctatttaagagtcatttgggatcaggtgtcctaataacctgggttactttccattgggtttattaaataactctggtgggaaggacagttgagaaatttgatgggaagttggggttcggacaggagtccatggagggtcccctcatctgcctttgtcaaccttgcccaggcccaggcagcaaccaacgatggattctccatgactcctaacacaatggaccccgagatgcctgtgctggtggctgatgctgagctagttgcagcaagggaatatttaaagcccccaggagagcctggcctgcatatcacaggacacactctgttagagagacaagttcaagtttgacacccatgcacaggagaggatgaggaatcttcccctgaaccagcctgcccagtacctgagctctaaccataacaagacaccaaagccgattggtgggctgggatgttgcagaccacctggttgagactgaatcccacgtgggcttgtgttagcaggcagggcaggttttgctgggttcgttaaggatgtgcacacagtatgtggttccctggagtggacaattgcctcattgcttgggcaatggacagtttaaggccaaacgagtgtctaggaccactggggccaagaactcctgagtttcctgctggagacctaatgtctcttgaaagtctctcagggaggcggccaaggtggcagtgagtttggtgttagcttgcatcacctggtgctctgtgctccaatgccttgctcttaagcccattctgggcaggcttaagagtctccatgcacatagcatgagtgggatgatcagtggtcgcttgaaatatgcaggatcaaactcctgtggttcctcctgtgttatttgaggagaattcctaagaagactagagcacattttaaaatgtaccactatccaccgtcctcctccttctcctagtcaggtagatggggtaaggtttctggagatgagaaaagaatgcagtcgctcgagaggcaataaatacctgtggtgaggttgctgaacccagtgtgcacgccgggcagcccctgccaccatgggaatgtcgtgcacagcgctggtcccacaggctgggtgctcagggccccccctgcagctctgtgtgaaggcagcaggcatcggccggtggaggcctgggggcagtggagtgataactaaagcatctccctcaaccttaaggtagaggaggcatctcaagctttgctagaggcggtcgctgtggcagagcagtggggtctcctgtccctctgaggaagcagtgaattcctgatgtgtggcaggcccaggaacttcagctttggaggaagtgagcaccagtctcaccccagcataagaagaaatttgggctcttcggggaaactgaggctctggtgacagttttagcttccagggcattagtaggtgcctgtagggtcgcaatgatgaggttatagggactaaatatgaaggggtgtatatgagcgagaggaagatctccgggttctggaaatgtcccatgtcctgcggaagtgaaacctggacctgcttcctgcacacagagcacactccagtccacaggcatttccacagcactgcatgagcgttatcactggagagctggtgagattcgggcgtggtattcttacacatagttctcccaagtctatagttttccgtagcttgtagggcagctttacaatctcactgaggctctatgggttccttgcaccataaagtaatgggcttattctgaaagcaaatggtgatctcagcaaaattccactctaatgaggtcatttttggtgtaatcagcaaagcatgaggtcagggaagcagcaagtcaagggtttgggtactggccatgagccagcaccatgtactggagatggcgaggtccgtatttgtagcagtaaggaaaggctggttggtggtgatctcgtggtcaaagtgattttcctctacaagggacttaaacaaataagtaagcaaaaaagaaatgagccctttaaaatgcgtgccagggcatgaacagatacttctcaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagtgggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccagcatgatctgacgtcagtgcctcacagggtctcatccctgagccctgtcagagctgcagctgagccagcaccccctgccacctgttcacaagtgtcttgggcctgaggttttcagatcccagcagcacttctcctctgatgcctgtggagagagccacctcccaattgcaaaagtgtgaatgaagacctgatcatgttgttttaatccattaagtcttgtggtgtcttttcatagagccctagatgaacagagggcaattttcacagtattggtgacaaattggacttgtactttgtgtgtgtaaatctcagcttctctaaaatattgatgaaataggagagaactttctcaattgaatcccaaagtgtcacaaagagcccattgtggtgggggcatggaattgtggactctttggagagactgaggaaccccgtctcacccattcttagtttgaatttttcctgtggggagctggggtagtgtgggatccaggtggagtctcaacctctcccctcagtgacagactcagaggagggtgtggaactccagagctggctgaaacaacggagagagaagtaggggttttctcccggagatcagctatgaagtcccagggaagatgaccattattcacacggctgtcatctggggagagaccccaagttaagatcaagagaaaaaagcgggaaacaaaatggtaaagacaacaaggtaactcatgcctagagtccttggatcaggcattttatgaagccagaagtctttcttttcttttctttctttctttcttttttttcttttctttttttttttttttttttgaggcagagtgtagatctgtcacccacgctggagtgcagtggtgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctaagcaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgtcctcatctgcccctttcccttgagttgatggatgcctctcagcacatcagcatgaattctactccgtccttctctctggcaacatccattcctctgaattcagtggaggtccaccctcatcctgcatagctcttgccctgatagcattctgtccaccaaacatttcattctacctctgcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagctttttcctgtggaatttaggaataacaattaataaatcattttatattgttatgtgctattagatgcaattagttaatgtaatcagaattaatttattaaccccctactttatgttacagtcatccatgcactctggtacaacaataagcaaaacatgcagcttcccttctggagtaaggaggcaaatgttacgtatagtaagtgaagtgtacagggagtgagatggtttcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccagttcatagttcagaatactatggaaagttaattcggggaccacatgattccaagtccatggcagtcacaggaagccaaagaaggttcctgggcttcacaccgtgattccctatttgtgtccttcatcatctaaacaagaagaagtctgggatcattacgcactctgtcctcccagggttcttggtgggcttccatatccatgcagtgtctcagtgggtacctgggcccctgggctgcctcagccccctgcagcaacaagaacgctaccatgttcctggtgaaatgctttccctccctcgtcccttatcccctctgaagctgtattttccaggcagaatcaggttctcagcagctttagggtaacacaagagagtgcgcgttgcaaagtgcggtggagcatttgtgtgtgtgtgttttctgggtgtgaagacaactgtatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgactgtttgcccagcacacgcgagctctttgagagtggatccagagaaaataaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgagatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcagtccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcacacagaatttgagactcattctcctttgctctcatttttgcattcctgccccatcacacacacacctgaacataccctcaggcttggctgcagtttttaaaagctcttctgtagagtaaaatgttctctttacaactaagtctacttgtttagatccagaaataactagtctgtctcttcatatcttaaacttagtgaatttcacagatgtttcttggaatcaagtctttggagaaataaagtttctcaggtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttacaagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgatttactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggcagaaggggcaaatatctgaatacataaggaattccaacaactcaatagcaaaaatcaaacaacctgattgaaagacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcacccgctgggtccctctggggcggccccacagtcagaggtcagattggaggcatagcttcaatgatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaagcctctgggacaacctggctgcgtatcatagtatacgccctgcaaagagactaggataggaatgccacctgcacacagaggaggatttggaatgtgtttctaaagcagtgtcccgaggacctgaggtctaaccataaaaactaatgaaagccatttggctgagctgggatgttggagaacacccaggtgagactgagtgctacctgggcttctgttgctatgtggaacagacatttttgggttctcctgagtactggatgtacacgcggcatgtggttccccagaggtgactatcacctgtttgcttggccaatgaacagtttaaggttaaacaattgtctaggatcatctgggccaggaactggtctgaggcattagccatcagggtgggagtggcctttccagatggccacccaagaagggaagtgggagtctgggcattcactttactgctggtgttggacagcctctcagcccttgtgggtcttcagagaagcatttagcaaaagcttgagtggtgctttctgggaggcataggagtttccatccttaactggtacccatcggagaacaggcgtatcccttagcccatgatcctgtctggatgctttatgtgaatgcaaggctccaactcttcaggctgctgtctgggtgtgtgctgcggcattgttagcccatttggattgaagcctatgcatccagagaactacctcctcatccttaaaacacgatctgtggttgtgagggctgctggtgtttaagcattggtgccatgggacccattcaatatctaagggttgagttgcccaccttggacacaggtcaggttgtatttggggtacagcccctctaacagggcttacagggaattccccagttttccagtctggggtacaaattctgactagggctgtcttgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccttacttcctgccaggaggagtaagtgggaaatattagctaacctttaaaaccggtaaaaaagggagcttttgccagaagctgcatgtgaaatggagaggtgtggtgtagcaaaagcctcgtggtcctgctgggtgccagtgggcctggggggttatcctcagaagatcgtagtttactatccatccacagtccattgttcagtacatgtttgatgttgagatggtggatgtcttgtgatgatatggggaggtctcattattggagaacatgtaaatgatgttatctgtaagggaaaaaagaagctaactcttctgtgatcaccaagataggcaccaaagtgggtctagcccaattgtgatgaggcagtggtggccatggggttgagagttaaaaaagtgacggcccttggaaggaccttggtgccttgggtgtccatagcacatccagagacattaataaccatgactttaggaggccaccgtgctgcttgaggaggctggtgacttggggacgatggactaaatgagtctcccttaacccaccctcgtgttgtgatgtcctgaggtgggagcctccatctgaatcaatgataggtgtggttctaaaggagatagtgaagaaatgccacgtaaagagaacacctgctccacgcagggcataaggagctacggtccctggaagactacacgtgcagaagctcatagttaggacaggtgtgctttgtccagaggctctgagagttgtggtggacggtagtgagggcctccccatgaaactcagaacccgggacccgggcatggtctagaatcacctgctggtccagcaacagactgtatcctgctgtggccccaatggatgtgaagggcttctgggtgatggcatttgtgggcccctgcagaatggacaagtggggtatagctgtctccaaagacaccatgtcccagtacatggagggcctactgcaaagtggctaggacactagtggtgaggatttggtttttaactgcaaggggactttgtcagcccactgacgacaaattgatgcccagaatctttacaacagtgctggaggggccatgagtgtgtcctgcagaaacctggtcactgtccaggaagagggagagcgggtgcagcagacctgcccgtgtgtcctggcccaggcggtggctttacatgcagcacccagagcgatttggggagctgagggagaacagagaccctccagctggctcagagtcacgggtggctcctgtccctggaggggtggccttctctgccccaacccagtcttgtgctctccttccctgccattcttggctgcaggactgggaaccatctgctgggacgttgctctgtgtctccctcatggccatgctcccatccttgcctcctccatagactgcggtcaggactcggcagcccagagccccagaagggtctcagtctgcgctgaggtcacacctaggcattgtcgccatcctcccgcaggtgattctcaaactccaaaactcaaattagaacagagagattcttccctgtggtccttttcacctttctctttgggctgcaccagaaccttggcagaattttgtggtttaaacaaaaaaggtgttatgtctacagattttttacagtactttcacttccatgttgatccatagtccccaaccccagcctgattttttccagtgattgcagccagtgtagacaatcagtgtccacactgtggacactatatgtagatgcagctgaagctgttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggccccagcagacagtgtgtgtggaccttgggcggggccctggggttatggttttgacccagcaggaaagggtagtcatggaacacagcatgcgtgttaccatggggcacagcgggggctacgcagaggtgagctctgaggaggaccctccacctcccagctcctcagagtggatggtggtgtccctcccctcagccctttgtccactgtcctgcagggagggtcctggtggtgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatgttccctaaattcttttattattttttatagaaagaaaggtttctgttctctcctgttaggtctaggatgggtaacattttgaccaacagactacatggaactagatgccatgctgttttctgggatcaggcgctagtgaactggtgtctttttctatctctctttggatggtgctgtggtctgagacatttttcctctgaaattcatatgttgaagtcttagaccctaggatgatagcattaaaagaaagggtctttttggaaatgaggaggtcagcatggtggagtcctcatgaatggaatgagtgcccctgtagaagaggtcccagagagctccttcattccttccaccagatgaagacacaataagaagatgttgtatatgaaccaaaaagctggttctcaccagacactgattctgctgccaccttgatttggacttcttagcctccacaggggattccgaatggtggcagaagttagggtgtggccatgcggtggagggttggaacaaagaagatgaagggtcactgttgtcccggaggacagagcgctgagaggtagtgagggtgaccttccaggcaatattagagtaacttagttcacgacattttgaattttttttagcagtccacatgtgcttagagggctggtgcctttggagcccagataccatgcttggaggaagactaagcatcccacagggagaggaactgagcccacctgcaaggatgggctagagaacactgagcaaccagctttctaggaaaaaagaaaactctgatttgcaatgtttgtaaatttctgtggttaaaatgctcccagctatagacagtttaagaattatcacacaaaaactcctccctcatgagctggcctgatctgaccccagcacatcacagggtctcatccttcagctttctcagagtttccagctgagccaacaccacctgccacctgtgcacgagtgtcctggccctgaaattttcagatctcagcagaacctctcctcttatgcccgtggaaggatccaaaccccaattgcaaatgtgtgagtgaagacgtgatcatgctgtttcaatccactactttctgtggtgtcttttcgcacagtcctagatgaacagaaggcacggtcttggtgagaagttgaatgtgtgcattttttgtgtgtgtaaatctcagcctctctataatattgttgaagtaggacagaaccctctcaccttatttccaaagtgtcacaaagagcccatcttaatggcagcgtggaattgtggactctttggagtgactgaagaacccccgtcacccattcttagtttaaattcttcctgttcagagcaggggtggtgtgggagccaggtggagtgtcaacctctccccacagtgacagactcagaggaggccacgggacttgggggttggctggaacaacatgggaagaagtagggattttctccaggagattagctacaaaagtcatagagagatgacgatgattcacatggttgtcacctggggagagagcccaaagtaagttcaagagaaacaaagggaaaaaaaaggtgaagacaacagtgtaactcatgctttgatttcttggatcaagcaattcctgaagctagaattcctcctcaattccaagatataggagtcaaaatgttaacttagcttgttgttggtttctgacatttgaattcaagaccccattaagagatctgaaaaacatcaaaaataccagactcagagaacctgaggcaaagatggtgcagtgcacaaggacaggagatgagagcagatgacaagtgtcccggggcagcttgagaccagatgacaggtgtaccaagggcagctggggcatcaggctccctggtgattcccatgcacagccccggggcagaataaccttgttaatgctgatcagcagggaaggaggggcagctatgtgagaggctggaaggacagcaggtgagtcagggatggggagcttcatagttgatgtgcagaaatggaggaattccaggtgatggcaggagttagtgggtggccgtgggtggagggcttgggcaaagaggagggggttcactgttatccaggatctcaaagcattgagaggtagtgagagtgaccttctggaaaatattagagtgaaaaataacttctcataatcttaagtttcttcgtgagttacggggcttttagcagcaaaagacaaaatatgccaaagttcagaaaagggaacaagtacttttcttatctcttacattcttgttgtaaacagagttcagaatatcatataaacaggcacagaatatcaacagcaacaataacgaggcagtatcctttgtttaaaagaaaaattgcaccagatacttttatgaaatgccaaggaattggtgttgaggaatgtcccaataggtgttaactctttgcaatagggagagcagttgaactcaactctcttgaggccaaacacaggagagtttaagccctagggtgagctggtgaaaaagtactggaggttgctggcaggaaggttgagcagtgtgattgggccatctgtgtttcccaatttgtatttatggaaggtaggctcctatcctcccacagagaaaagggtactttcttcttggaaaatgacatttcaaagggttagcttcatatttgacttattctttattttcttctactgtatgagtggcttatttaaggtagaaatatctcactggcattccataaatgtactgtgtgtgtgcattccagtaataagctttgggttttatttgaggctaagcaagttgctcccattgtttggagaccctcacacctctccctgcattctctgtccttagtgtttgcagctgtcatcgcgcaccctagactgcagtagcagaatcttaatgtggttctaccagtatgcctttatcaacacagaggagcagggatattccatcctcgtctgcccctttcccttaaattgatggatgcctccgagaatatcagctcgaattaccagttcatccttttctctttcaacatcaattcctccaaatccagcagacttagaccctgacctggcatatctctgtccctgataccattatctccagcaaacgttcttctctaaccctccttttaatctattcagttgtaaacatctttatgttccggtttaagatacaccataaaatctgtccttgccactccaagacaaaatgatctcttctttctaaagtcctaatgttacttaaagccacattttaccagtgatattctcctatatttcattcttaaaagattttagtttttgaaaggtctgctgtcacatgaactgacatacagaattttttcttctgtaggtttcagctttttttctatgaagttgagtaataataatgcaattttgtaatagtatgtgatgttggggataattaataactcagaattaatttgttgatccccagctatgtgttaggcagtcatctgggcactgtggtacaacaatgagcaaaacatgcagcttcccttctagcacagagagagaaatgttaccgagaataagtgaaatgtataggatgcgaaatggtttgaaatgctacagttagaaataaagagaacaaggaggatggaggtatccaggggaacttgtggcaatcttaagttgggaaatcaagaaagatttcagtgaccaagggatgttttagctgagaccccaggagctggaggagtgagccaggtggacttctgggtgaagggcagctgccccaaaatgaagtgatcctggcccagtggacagttaggaataatttgcagttagttcaaggaccacatgactccaactccaaggcagtgacaggaacccaaggaaggtggcttgtttttcaccccctgaatcataatatgtgtccttcactgtctacacaagggggaagatctgggagcatttattttgtcagacaccaacccactgtgtcctccttgaggtctgcagtaggttccccagctgtgcattgtctcagtggggtgcctggaaccctgagccgcccctttacacaggcagagcctcagtctgggactgagacctgctcggaatctgcatggattggatgtggacaacacctacttccttctcctgggtgctgggcatttgtggttggtgttggtggtcacagctgtgtctagactcattatattgttttattcaagaatggtgaataatccacttgaaacactatttcttcctttgcaaactatggtctctctgtcactgtaagggttcttggggcattttaccagtaccacccaataagagtagccaaggcttgaacagacatatttttattcaaaaaatgtattgtggaatcacaaactagcactactaaatttaaagtaaaataaagactctggggctcacgctagaatacttcccggggctctggggctcacgctggaatccttcctgggcctttgtggtcatgttctcataggctatttgcaggatatgttgaactagtgttcaaggttcaatgggtgcctagagaaggaaagagaagagatacaggaagggtcacatcacacctcagcaagatgtcagcctggcctcagggacaccggtagcgaccctgtcctcttggaggagaggagaaagacaggctcaggaaggtacatacccaacgtgtgctgtgcctggtggggaggctgcagttggaggcaggacaacagggggcgctgtggtcttccaggtaattgctctgagcatctcagagggcgctcaactcctggttcattccctttccgcagacctggtttcctgctcactggctgatgtgcagcactttctgagtatcagaacctcagcgccctgcagcaccagccgggacgcagattacttcgatagcttttccctcacttctgttttcccggtgcccctttaaaactgtattttcaggtagaatcaggtcctctgcagttttaagggaacacaagagtgttaccagatggaagatcttgactgtgagttgtccagattcttagtgcattgaacaaataattcaacaaaacgtacaaacaaagcaacaaaagaacaaagcaacgaaagacaaaccaaagcaacatgagaatgcagtaacgaaagtacagatttattgacacaccacagagtgggagccagttcaagcaagtggctcaagagccccccacttagtgtttttattaagctcaaagaatttggtgtgctgcctaatcttgcctggaactggctgcacctggtgttcttttccttatgccttaacccttgattatcctatttccctattctcctgtctcaagggtgcatctttcagaatacagttgaggaatctgcgttttgtttgtgtgaagacaactttatgaatatgaaatcaagattttccctggcatgggtggaaaatattgatgatgagtctgtcgcagcgaggtgctcctatgcttttcgttgtactcattacaggatttgttttgttttgtttttttgatggagtttcgctcttgtcacccaggctggagtgcaatggcatgatctcagctcaccgcaacctccatttctcaggttcaagtgattctcctgcctcagccttccaagtagctgggattacaggcatgtgccaccactctcggctaatttttgtatttttaatagaggcgaggtttcaccacgttggccaggctagtctcgaactcctgacctcagatgatccatctgcctcagcctcccaaagtgctgggattgcaggcgtgagccactgcccccggtctggaaccatttctttggtgctgggattacaggtatgagccaccacacctggcccattacagctttcttaactgttcattccaatctcaattaaatttttttcaatagagctgtgacaaccccaggtcttcaaaggcagatgtgtgacctgggtctgttcaatgaaactccaacacttcaggaaagaacatggtggttttttccctaagaagtagcgatgttatgattgtgtaaactgaaagctgataatgactgtttttcctaacacatgggagttacgtttgagtgaatccaatcaaagtgaagcagagtgaaaagacagagaagtagaaggagaaattggcagcataatttgtgcttgtaaatcagtttgtgtctgaagccaatgtttgtccttgatattcttagaatttggagttgtattttgcttaaaaagcttaatttaggattctggtgcttgcatcccaaagagtcttgactaagaggtgcattaaacaccaaacaggtacaaacacaaacttgctacaaagactttattaggaataagggaagaaattgaagacaaggtaaaggagtaataaaagttctcctctagatctcaaagcaaatgatgaacacattttcctctgtgctccatgatcccactattggtgcaggtcccatagcggtgtttggaaaaatgacagcctgatattctgccatagcagaccaagcccgtcgctgagcctgaagacacagagaaagcatcaggcattgggactggggtcagacgcggttggtaaggagaatccccgtgcagttacttactgggctgattgcattcatcatggtggccacaccacagcagcagcaagatcagctcaatcaataggaatcaacgtacacagcagtgctgctcacaggcaggattagagacttattctcatttgctcactttttgtgatgctgcttcttcacacacacatttgagtacacccttaggtcccttcccatttgtgaagctcctctaacaaacaaagtgaaatatgtttctttccaagtgggttctcatcctcgatgccagagagactccccagcgtgtttccacatagcataagattactaaatttcactgacttttcacagaatcaaatacctttggaggagcaatgtccattgaatatcatctgattctgtcttttcagtctacacttgaggaaattgaggcctggagaggtgatcacctaagagaaagaaccagctattgggtctgattctagcggtgcctggttttcctctctagactcctggctctgcagtgctggtggctctcacctgaatctctaaaaccagagcttatgtcccctgtgaaggagatggcaaagtcctggtggtctgccccaagctgctcctgggctgcagcctagtcagctcttgcctggagtggctcaagccagggcctggagtggcaccaggagaatggcagcgaggagggtgagggtcctcatggctggggtcacctggaggatggagagcaggagtggatgtgtggggagtgataagccagcttggatttatagctctgctgggagaaggctcagagacagatgctgcagtgagaggaggtggagcatgtgattggggaagggaagggctgcctttgccatcaagatccctttgatgctcttctgttctccgagcttttatcatagcatgagtctgcttatcgagtgtctgttctgggtccaagccaatagtgatgattaggatcatgctataatttcctgtgtctcatctgctggaacatttacttcttaatattcaaaaaagaaaagaaacactgctcttattccataagttcaggcaataaatgcctcttattttctgaagatgagccctgctattcttggtggtctagaccctgaggcaagacctggaccccagcatagagagtaattcattgcaggattctggggcatttctaccctcatgaaggacgcttttgaggttctggaaggcatagtcttctgccactgctagtgtggagaggacaatggcctcatcaggctatcagtcaaataagctcagtgggatactagttaaagagttggtctgaataaggttaaaaatttttttttatttccaaccgtattgagaggagtgacaattagaaattatatcggttgaaagtacacaacctgataattcaacgtatatctacatttgtacccttatctcacaccaaatgtaaaaatcaactctgaatgaattgaagacctaaatataagtcttgaaatcataaaacttactagaagaacccatagggataaagcttcctaacgttgaactgggagattatttcttggatattacattaaaggtagaggcaactaaagcaaaaataaaccagttggagttcatttaactgtaaaacatctgcatagcaaaggaagtcattaactgagcaaacaggcaacctagcaagagagagaaatatttgtaaacgatacatgtaatgaaagtaaatatctaaatatataaagaacttaatagaaaaaaacgagtattaatgataaatgtgactaaacaactaaaagaaaccattattacataattaaaggaaactgtgatgacaaaatcttttcaagggcagaatataataaagtgaagttacgaagaaacacatgaaattctggaattgagaagtacaataatcgaaatgtaaattttatgaacggctgctcaatagtatacttaaactggcagaaccaagatttaggaaatgtgtgtacagatagataaaagattatatagtccagagaacagagaaaaaagatgaagaaacaagaatacagttagagaaaagtgagatactattaggcatgaaaacactcactgggttgagaggtgaactctcaatctgttaaggcagcagtccccaacttttttggcatcagggacatctatgaaaaacttacaactaacatcatactcggtggttgaaaaaaaaaaaaaaggatgctttcctactgaaattagaaaccagccaaggatatctgaaatcagcacttctactcaacattgtgctagaggttctagggcagtcaggcaagaaggaaaaattaaatgacatccaggttagaaaagaagttgttaaataatctctgtttgcaaagacatgatcttttatatatagaaaatccaaaacaatttattaaaaaactattagaactaataagggagtttagcatggttgaaaaatagaagaccagtgcacaaaaatcaattgtattttttctttcataataaacttttcaaaaatgaagctaaaaactccttttacaagtagtatcaaaaggaacatagctagtcgttgaatttaaaaaatgtgcaaaacttatactccccaaaccacaaaaagttgaagtttttaagaatatctaaataactggaaagagatcttatgctcagggattgtgaggtttaatgtgagatgtcagtgctccccaaactgatctacagattcagctcaatctatttcagaatccctaatgacttctttgtagaagactttctttgtagaaactgactaggtgattctaaaatttatatggaatagcaaggatcccagaatagctaaataatcttgaaaaagaagaaaagattcctgttttcaaagcatcctacaaagaaacggtaatcatgacagggtggtactgctgtaaagatagacatagatcagtggaatagaattgagagttcagaaataaaaacgtgtctatggttattaactcactttctgcagtggtgccaagggcattcaatggaggcaagaaaattcttttcaacaaatggtggggtaaactagatggccacaagcattagaatgagttggaccctacctcacactatatttaaaaggtaattcaaaatgggttagaaatctaaatgtaaaatctaaaagcataaaacttttataaggaaacataggggtaagccttcataacctatgtttggcaatggattcttagatattatatcaaaagcatgagcaacaaaagaaaaaaacaggtaattggatattatcaaaataaaaatcttttgtatttcaagtgacactatcaagaaagcgaaaaggcaactcacagaatgagagaaaatacttacatatcacgtatctcatgaaagacatgtatcccatgtatccagaatatatgcagtcctcttatgataaacacttaaagctaaataaacaaatttataaacgggcaaaggatctccttagacatttctctagggaagatatacagatagtcaataagcacatgaaaaaattcttggcatcattatttattaggaaattcaaatcaaaaccacagtgaaataccacttcatatccaccagggttttttagaatcaaaaaggcagataatagacaaaacctgtcgaggatgtggagaaatttactgctgtggtgtaaaatggggcagtctctggggaaaacagttttattgattctttaataagttaaacatagaattaccctgtgagctaggaattccactcctaggtatatacccaaaagctatgaaagtgtatgtccacacaaacagtcatggggaagggcaagaagccagacataaaagaccatgtattacatgattctgtttatacaaaatatccagaataagcaagtctatggggacagaaaatagcttagtggttgctcagaggtagagggatgggaatatcggaagggaggaatggaaagtccttgggttctttatgaagtgatgaaaattaatttgaatgtggttattgctgcacatgtctgtgaatatactaagcgccactgaattctgcactttaaatgtgtgagttgtacatcatgttaattttatctcgatagagtggctttaaaaaacaaaataacacgaaaaatgatataaccaatttttttttaagttaccaaatgcatttcctttctctatatatggtgcactactggtttggggccaaatataaaataaaatatgttggcatgatggaaattgtgttatattgctacattaatggtggtttattatgtgacctggattagtgtaatctgagagatatttgtcgttacgtttttccaagcaaaccttgtttactcaaatgtggaggcaattattaccacttttcttcactcccaacttttttataagatcgtgtattcaaaaagctgttttgggacaactaaaatgttaaatattttatgctatatgatactattatcatttttgtttgtctgttcgttgtgagacggagtttgcactgctgcccaggctgaagtgcaatggcgcgacctcggctcactgcaacctgtgcctcccaggttcaagcaattctcctgccttagcctccccaagtagctggtattaaaagtgtgcaccaccacgccctgataatgtttgtatttttagtagagatggggtttcaccacattggccaggctggtcttgaattccatacctcaggtgatccgccacccgcctcagcctcccacagtgctgggattacaagtgtgagccaccgtgcccggcctatcatttatttttattgtgtgtgttgttacagttcaatgtaatcgtcaattataaaatgcctctcccatttcacatttcataagagtaaagagtttttttaaaagagactttctagaatagagaatgtgacataattttattctcttttgatattggaaaagtaaggatttttagaagatttctaggcaaggcagagaactcagttgtgctttaattggatttacggcatggggactttttctcagcatcaaggtgaaggtgagaacagtataaaattgatgtgggcttagcatttggcatttgcccagagagataagagagtggggggaaaggaacgaagtcctcattcaacagtgattaagtgatggaacatagaccagggctggatgtgaaagaattaaaagagtttggacaactgattgggaaatagtggtgttcctagagaatggaagtgttgacgacactgagtgacagtatgggaacggctgagtcagaaagattgaggggtggggacgaggcatggtaggatgctggaatctgcatttttaaggtgagagtatctccaagtgataagaagattgatgttatggctgtggattgggtgaacaaaacagagtataagggaggtttctgaaaccaacaggtcaaggatccctgaggttgttgggagccatgtgagagcaatgccatttcccacaccacagcagtgttctcaaagccggagctctgaaccagaagcacctgcatcacctgggaacatggtagcaatacaaactcctggatcccacctcagacctattgaatcagaaactctgtggaatgggtcctagcaacagtgttttactgagacctctgcagacctagtggaggtttactgctcatagaccatcatcactcaggacaaagactctttctcccaggtccttagaaaaacagtggacataaatgctttctgttaaatcccattgctgaagtccgttcagagtgaaagaattctgaaacttttcagccatttccagagatgtgccttttgtgtgtaaatgcatttgttttatatttacttgaacttggcattcatttatccactgtgaggtggccttttaaccaaggcccaggtttccaattaaacctgcctccttcaccccaattttttttgagacagtcttgctctgtcacccaggctggagtgcagtagcacgatctcagctcactgcaacctctacctgctgggttcaagcaattctcctgcctcagcctcccaagtagctgggattacaggtgcacaccaccacactcagctaatttttgtatttttattagagtcagagtttcaccgtgttggccaggctggtctgaaattcctgacctcaactgatcccctcctctcggcctcccaaagtgctgggattacaggtgggagccaccatgcccagcccttcaccccacattctgcttgttcattgtgaattaaaggtgtccacatcactttccctacttgctcaaggggaagacaacaattaccctatcacctggcaatccttcccaggagctattcctaagctaccctgatctatctaagaggacaagattcttctaagggtaagtggtcctgatttcctggtcttgacctaaaggggaattctgtaattgtctgatctacctttgggaaataataagtggccccagcttactctgtggaatagaagataacacagcctagtccacatggtggttggtaaacatatagacagacgggaagcagggactcttattgggatccatatcacgactcatgaaatcatcagaggcaccaagcaaatagatggcacacctggaataagaagaacatcaaagggctttggagacaataagggaacttcaaatggtttgctttcctctcttccctctcctcccagcccccatactcacatatggacaaatgtccaagccctattcagcaaagcccattactcttgggtccagctttcaatgaacaaatgcaaacacaggatgggtatatttctccctcattagccatcaggcttgtgcagcttcgtgagaagaaacgactgtcccctgtgatgaccggtagtcatgaggaccttatctctgctcagcgcccttctctccttcaccccaccccaccccacatcgaagccagagcattttcactgaagttcaatctgtttgtgccaagggctctttcttctttttcctcagtagcttcagtatgtttccaccttgagatgtcctcagttatcagagggcgacttagcagtgcccatgctatattcccagtcaaggagaacctgctctgacagaaagctgggccagcagagccacagtagcaccttaaggacagcaggcggcgctcctgccccttataaagttaccctggaggaactgcataggtacactactgaatagcggtgtccagcaaattcttttttttttttttttttttttttttttggttgttgttgttgagacagagtcctgctctgtcgcccaggctggtgtgcagtggcgcgcgatctcggctcactgcaacctcgcctcccaggttcaagcgattctcttgcttcggtctcccgagtagctgggattacaggcacacaccaccatggcaggctaattttttttgtgtttttagtaaagaccgggtttcactatgctgaccaggctggtctcgaacctcaggtgatccgcccacctctgcctcccaaagtgctgggattataggcatgaaccaccaggcccggcctggaaccatttcttggttggacacagacccactctgtcctccctgggatctgtattgggttccctagctgtgtagtgtctcagtggggtgcctggacccgctgcctagctgaagctgcctcttcagacagacagagcctcggtctggggctgagacctgcttagaatctgcatggggtgaatgtggagaacaccggctcccttctcctgaggtctgggcatttgttggcggtgttggtggtcacagcagtatgtgggcccgttgaattattttagtcaagaatggtaaataactcacttgatattctgtctctttgcaaacagtggtctctctatcagtcttggatttcttaaggcgttttaccagagcccacctgataagagtagccttggctcaaacagacatattcttattccaaatacgtgttgtggaatcacaaactgaaactgctatattccaggtgaaataaggagctggcactcacgctggacgcctctgtggggtcttgtggtcagggactgacaggccatttgcaggacacgttggataattgttcaagggacagttggaatctggggaaggaaacagaggggagacaggaggaagagtcacattacacctcaacaagatgtcagcctggccctacagagacaccaggtttaggcagtgaccatgtcctcttggaaaggaagaaaaagacaagctcaaaaggacacaggccccaagagtgagatatgaagatgagcaacagttggagacagcctgggagggaagccgtgaccatcccggtacatactctgaggacctaagagggtattgctgttgctgttcctcctggaaggtcctgataatgaatctatcacagtgtggtgttcctgggctctttgtttgattcattacagctttcttaacaactcattccaatcttcaaaaaaaacaatttttttttttttgagatagggtctcactcttttgcccaggctggagtgtctcactctgttgcccaggctggagtgtctcactctgttgcccaggctggagtgtctcactctgttgcccaggctggtgtgtctcactgttgcccaggctggagggtctcattctgttgtctaggctggtgtgtctcactgttgccgaggctggagtgtctcattctgttgcctaggctggtgtgtctcactgttgcccaggctggagtgtctcattctgttgcctaggctggtgtgtctcactctgttgcccaggctggagtgtctcactctgttgcccaggctggattgcagtggtgcaatctcagctcgctgcagcctcaacattccaggctctagcaatcctcccacctcagcctccctgatagctgggaccatgggtgtgtgccaccatgcccagctaattttttatatgtttttgtatagatggggtttcaccatgttgcccagtgtggtctcaaactcctgcaacccaccattccaaccttagctaaagttgtttcaatagaactgatataacccccaaacttaaaatgtagatgtgtgatccagtttggttgaataaaactccaacaattttggaaacagcatgatggtttttcctgagaaggaatgattttgtgattgcataaacttttagctgacactgattgtctgcccagcacacaggacttctttgagagtggatccagtgaaaatgaggcagaatgaaaagacagagcagtggatggagagatcaggggcatcatttgacctttcatatacatgtgtctgaagccagaattcttccttgaagttcctagaatttggatctttattttattagatcggcctggcccggtggctcacgcctgcaatcccagcactttgggaggctaaggcgggtcagtcacgagttcgggagatcaagaccatcctggccaacatggtgaaacaccgtctctactaaaaatacaaaaattagccaggcgtggtggtgggcgcctgtagtcccagctactcaggaggctgagacaggagaattgcttgaatctgggaggcagagcttgcaatgagctgagatcccaccactgcactccagcctgggtgacagagggagactccgcctcaaaaaaaaaaaaacccggaaatcatgttaccaagtatttatttgggatgaggacaggaaatcgaggacaaggtataagaataacaattccctttaatgctcaaagaaaattatgaactctttttctctagtctgcaagcttagtagcagcagattgggtagcgttcaccaaggatgaagcaggtcccaccaagatgttctccaaaaatgcagtatagtactctgcaatggcagatcaagccctttgttgagcctggggacccagagagagcatcagaaactgagtacggggtcagcagtgggtggtaaagggaatcttggagaagtcacatgttggctgatgagtgatgttggctgtattacagccggtagcacaaacaatctcagtcaataggaataaatacacagagcagtgctggtcacacaggattcgagactcattctcctttgcttcacttttgtgcattcgtgcccatcacacacacacctgaacacattcttaggctcctctccaggttctaaaacctcctatatagacagggtgaaatattttctatatacttaagcttgtttgtctggctccagaaggaactaggtagcatctccttatatcttaaatatagtgaatttcacagtcatatcttggaatcaagtttttggagaaagaaaaatctcttagatttctttggttctctattccatttagatatgagaaaatccaggaccagagatgttaagtatagccacctaagtgacatctgccactgagatccaattccagagcctgtctcctgtccttctgtctagtctgtagctctgcatgctggcatctctcacctggaacctgaagagagcagctgtcatctcctgaaaagtaaaggaccacatcctggtcatctgctggaggctgcttctgggctggcatctcatgagctcttgccgggagcggctctgcccaggcctgaagggccaccaggagaaaggcagagaggagggtgagggtcctcctaactgtagtcacctggaggagaggagggagagcaggagtggatgtgtgggaacggaggagccaggctgaatttatagctctgctgcgagaaggctcagagatggatgctgcagtgagaggaggtaggcatttcgttggagaggttgcaggtgtccattggcctccacatccttctgagactcctctgctctcccagctttcattctagtgtgaatctctaggtttagtgtctatgctagcttggaattcacggtgatgataaggaccctaccattatttctgtttttacctgtttaaatatttacttttaatattgcaaaaagtaatcgaaacagtgatttaattcagtaatttcagggaataaatcctgcttattttctgaaaatgagagctcttctcttcagagatccagaccctcataacagacctgaattccactgtagtagagaactaattcattgcaggattcaagggcattatcaccctcatgaaggggtttttgaggttaggggatgagcagtctcctataggagctggggtagagaggacagcaacctcatcaggctataggtgaaacaagttcagtgagatagagatagagttgattgaaagataaaaatatgtttattattttcagctcaatgtgtgtaaatagacacattgtatgtgtctaatatatactaccttagaatttgagatatgtatacatgtggtcttttttcttataccacatacaaaaatcaactcaatggattgaagacctaaacataagatctgaaaccataaactactagaagaatatatagggataaagctttttgacattaatctgggcaattatttcttggctatgacatcaaagggacaggcaataaaatggaaaatagacaagcggggctgcgttgaacactaaagcacctgcacagcaaaggaaaccaccaactgagtgaaaaggcaacacagaacatgagagaaaatatttgcaaaccctacgtgttagaatgggtaaatatccgaatatacaaggaagtcaaacaattcaatagcaaaaaacaattaatctgattaatcagtgggccagtgagcccccatgatggctcacacaggcaatctcagcgctttcaaaggccaaagtaggaagatcgcttgagcccaggagttggagaccagcttgagcaacacagtgagactccatctctgcaaaataaataaataataaatgaaaactccatgggccaagaacatgaatagacttttctcaaaataaaataatgttttagcagctatgagtatgatcatctctgttggacacgttaagtaggacatgtgtgtttggaaggaaactgcttgagtttattaactgagctcatagccactgcccccagcaaccaacagtcccagatggcaaaatattccctcactggttccctctgaggtggccccataatcacgggtcagattgggaacacagcttcctgggtggaaccgcagtatgaaagtttaagttttgtattgtattactgacagattgttaagctacgtgaggctaccagagtgggcagaggacagtcccctgtcccaggcctcatgttgccacatcagcagctgtgcacaagcaggaaaggacttcccctatttaagggtcttttgggaacaggtgtcctaattttcagggttactttctattgagtagtttaaatacctgctggtaagagcagttgagaaatttgttgggaagctggcattaaaataggagttcacagagggataccttgtctatggtcagccctggccaggcccaggtagctaccaactatgaattctccatgactcctaagacaattgaccctgtgatgcctacactggtgctgaggctgaactatctggaccaaaagaatattgaaagccactgggacagcctggctgtgtatcatagtatccaccctgtaaggaggctaggctaagaatgccactcacacacagatgaggatttggaatatggcctgaaccagcctcctgggaacctggggtccaactataaaaacaaatcaaagctgtttggacaaacaggtgtgttggagaatgcccgggtgagaggagtaccacctcggcttgtgttgctaagcagggcaggtttgttggactttccggaattaaggatgtacatgcaacatgtggtttcttagagggagcaaccacctcttctcttgaccttagagagttcagactgaacaattttttaggaccgtttgggcctagaaatcctgagatttttaggtgagacctaatgtgtctcagaggtctcacaagggagggggccaaggtggcagcaagacggtgctgtgtgctcaaacaccttgttctaaagccagttcagggcaggcttaatggccaccatacactcagcatgagtgggatgattactctatgcttgggatacacaggaatgagctggtatggtccctcctgggttatttgagggggagtcctagggagaatagtgcacattttaaaatgtaccactctccaccctcctcctcctcctcctcatagtgaggtaaatggcatcagttttctggaaatgggaaaagaatgcagtcactcctgagggaataaatacctacagcgaggttgccaagcccagtgtgcaggccgggcagccactgttgccatgggagggttgtgcacagcgctggtccagcaggccggatacacaggacctcccctgcagctctgtgtgaaggcagcaggcaccgcgctgtggaggacttggggcagtggagtgagagctgaagcgtctccctcagtcttaaggaggcaagaggcatctcaagcctcgctaggggtggtcgctgttgcagagcagtgaagtcggctgcccctatgaggaagcagtgagttcctgatctgtagcagcccagcaatttcaccgttggaggaagtgggcactggactcattccagcagaggaagagattagggccattcagggaactgggccccagatgatggttttaggttctagggcattagtaggtgcctgaagggcccagtggatatggatgtagaggcaaaatgagaaggggtgtgtgtgcacgtggggaaagtctgctggttttgggaaacgtccagtgtcctgcagaagtgaaacctggaccagcctcctgcacacagaacacactccaatccacaggcatttcctcagtaacacatgagcgtgctgttatggggagagctggttaaatttgggtgtgatgttgttacgcacaggtctcccaagtccatagtttttgcataacttgtaaggcagcctcatggtgtgacctaggccctatggtttccttgcactagagggtatagctaatggggttacatgaagacaaatggtgttcccagcaaaataccgctctatgaagtcacctgcagggtacgcaacaaagcatgagctaagagagcagctaagcaggggtccaggtactggatgtgagccagcaccatgtcctggcggtggtgaggtccctaccctgtagcagtaaggagaggctggtttagtggtgacctcaccatcaaggtgagattccttggagtcccctggttctggtgaggctcttgttttccttgacaacccttgggttggggcgctgtggtctgaggctgttgccatccatgacccctaccccagtcgatttttccatgaatttctacaagtgtagacttccagtgtagacgtggttgaaactgttctctcatacacatgcatttgaatttccagagaatattgaagtgagcctgcgctaggttggagctgaccataagagccttgacaccatcaggctggagtatatattctgcggaagctgtgggtggggctgcaggtgtgggtgtgacaggagagagggctcccggagcagcaaggatattcccacacagctgaggctgtctggtggccccagcagacacagggtgtgtggaccttgggcatggccctggaacatcgttttgacctggtagggaagggcagtcttggaacctagcgtgcgtgttagcgtggggcagggcggaggctgcgtgggggtgagctctgaggactgtccacctcccagctcctcagagagcaccaccctgtccctcccctcagccctttgtccacccgcctgtggggagggtcctggtgctgcctgtgccacacagcgactcccacgcctgcagatccagctgggacaggcaggagttccaagtccctggcttttgtctgcctttcccagccacctctcacaagctgtctatctgtctagtattggcgtctgcagaaattttacaaaaaactatgagggaataactccgttgagctgtttaaaatgcgtccctaaatcattgactctcctcacacagaaaaggaggtttacttatcccctattgaatcgagacctggtaacatcttgacaaattgagtgcacctgacttagtgccatgctgtttttctgggatcgggcctgatgaactggtatctttcacttcctctctattggatggtgctgcaacctgaatatttttgtccctctgaaattcatacgttaaaatcttaaaccattagttgatagtataagaggtgggagcttttgggagttaagaaggtcagaagggcacaggctttatgactagcattagtgcccttatagaagatgccccagagagctccctctctggtgagagggctcactagatgagaatacagtgagaagatgccatctatgagtcagaaaagcagctctcatgacaccaaatctcctggcaccttgatttagacttatcagtccatgagaaacacatttctgtttttataagcagcttggtttatggcattattttgctagcagcccagacagactaagagcgctggtgactttggagcccaggcaccatgcttagaggaagcctaagtgttggacagggagaggaaccgagcccatctacaaggactggctagagaatgcaaagcaacccgctttctggggaaaaaaaaaaaaaaaaaaaaacaaaaaacaagaaacaaaaaacaactctgatttgcagtgtttttaagtttctattcttaaaattctcctagctatagatcatttaacaattatttcacaaaaactcctctctcatgagccagcatgatccgaccccagcatatcacacagtcccgtccctcagtcttgccggagctcccacctgagccagcactgcctgcccctgtgcaggagtgtctcagccctgagatcttcagatcccagcagaacctctcctctgatgcccctggagggagccaggccccagttgcaaatgtgtgagtgaagacctgatggtgctgtttcaatcctctgaattttgtggtggctttttacaaagcagcaggtgaacagggagagaagttctcattgtcatggagagaagttggacttgtgcactttttgtatgtaaacttttgcttctctaaaatatcgatggatcttctcactttattttcaaagtgtaacacagagcccattgtggtgggggaatgggattgtggactttttccagtgactgactaatcccctgtcaactgttcttagtttcaattcttccttggggagtggggcgatatgggacccaggtgtggtgccaacctccgccctcagtgacagattcagaggtggccttgggacttgggtgtaggctggaacaatgggaaggaagtagggattttctccaggagatcagctatgaaggtcacagagagacgaccatgattcacatggctgtcacctggggagagagcccaaagtaagatcaagagaaataaatgggaaaaaggtgaagacaacaatgtaacttatgctttgagtccttaaatcaagtatttcctgaagccagaattccccctcaattccaagatataggagtcaaaatgttaactcagcttgtcatggtttgacttttgaattcaagaccctactaagttgtctgaaaaacatcaaaaataccaaactcagagaacctgaggcaaagatggtgcagtgcacaaggacaggagatgagagcagatgacaggtgtactgggggcagtctgggcatcaggctccctggtgattcccatgcacagcccgggggagaacagccttgttgatgctgatcagcagggaaggagggacaggtacatgagaggctggaaggacagcgggtgagtcagggatggggagcttcatagttgatgttcagagctggaggaattccaggtggtggcaggagttactgggtggccatgtggtggagagctgggacaaagaggacggggagtcactgtcatccaggaggacagagcactgaaaggttgggagggtgatctgccaggaaatattagtgtgaactctttcccttagttttttttttaatgagttatttagcttttagtggcaaaggaagaaatacagaacttcaaaaaaggaaacgagcacttttctcatctcttacattctggttttgtttgtaagcagagctcagaacaaacagtgatacagaacaaaacaactctgtacttttcttgtaaaagaaaaatttcaccaagactttcaagaaatgtcaaggaaacgtttattgaagactgttgcaataggagtcacaacgttgtaataggaagagccgttggactcaacttacctcaagccaaaggcaggagaatttaagccttgaggggagctagcaggctagctctggaggtcgttaggagggaagttggctagtgtgattgggccatctgtgtttgctaatttgtgcttgttggaataagtctcctatcctctcacagagacagggctgctgccctcttgtgtaattacatttatatggatgaggcatctgacttattcaatatttattgttccaccacacgagtggttcctggtagaaaatctcttgtatgtcatcagtgaatgtagagtgtttgtgcatccagtgaacagttctgggtcttacttgaggccgagcaagttgtcctggttgtttggagaccctcaaacctctccctgaattctctgtctctagagtttgcagtagtcatagcccaccgtagactgcagtagcagaagccacatgtggtgctcccagtgtgtctttatccacacagaggagcagggaggctccgtcctcatctgcccctttcccttgagttgatggatgcttctcagcacatcagcctgaattctactgcatccttctatctggcaacatccattcctcaattcagtggaggtcgacctgaccctgcatatttcttgccctgatatttttctctccaccgaacattctactgtaccccttcttttaatctacccatgttttaaatacctctgtgtttcaccatgaaatcttttcttgcactcaaaaccaaaatagtctgcttctttcttctaaactcctattgcttcatgaagccacattttcccaaggatatttttctatatatcagccttcaatgtttttaattggcttttttttccatgctgccacagaaacttgatatatagactgctttgtggctgtagttttcattttttcctatgcagtttagtaataataataatctaattttatatcactatgtgatattagatatgattaattaattttatcacaattaatttgatgatctcttactatgtactaggcagtcatctggaccctgtggtacaataatgagcaaaacatgcaacttcccttctagagtacggagggaaatgttacagagagtgagtgaagtgtacagaatgtgagaccgctacaattctacagttagaaataaagagaacaggtgggatggagattgcccaggaaagttgctgcagtttaaaattgagaaatcaggaaagacctcagtgacaaagtgaaattttttagcggagaccccaggtctgggaaatgagccaggtgtacttctgggtgaaatgcagatgcccctgggtggagtcagcctggcccagccgacagtttggaaaaatacggaatgttagttcagggacctcaggactttgaagcagtggcagttactagaagccaaggaagcctcctggccttcacaatccaaagttctgtgtgtgtccttcaccgtctaaacaaggggaaggttgggatcatttgtctgtcagaatgcctttgtcctccctgggatctgtgttgggtttcctggccgtgcagtgtttcagtgtggtgcccggactcctgaactgcctcttcagacaggcagagcctcagtctggggctgagacctcctcagaatctcatggggtggacatgggaaacaccagctcccttctcctgagctctgggtgtttgtgattggtgttggtggtcacagcagtgtctggcccttgagatgttttggtcaagaatggggaaaacccacttgaaatgctgtatctttctttgaagtctgtaatctctctgtcccactcaaactccttgtgtcattttatcagtgaccacctaagagtaactgtggcttcaatataggttttggtatattgtgtttctaatttcatttgtttcaagcaatctttaaatttccttatttttttattgacccattggtcattcaggaacatgttgtttaattccatgtgtctgtacagtttccaaagttcctcttatcattgatttcaaattgtattccactgtggtcagaataatacttgatataattttgacatacatgatataggtttgacttaaaaatttgttgagagttgttttgtggactaacatatgatctgtcctggagaatgttctatgtgctgatgagaagaatatattctgcatcagttagatgaaatattctgtaaatgtcagttaggtccatttgggctagagtgtagtttaactctgatgtttggttttgttaattttctgtttaaatggtcagttctttattgaaagtgagttgttgaagttttctactattattgtatttcagcttatctctttagatccagtaatatttgcatttgaatgctctttgaatttttatatccttttgctaaattgaccactgtatcattacataatgaccctgtttgcctctttttgtaatttttgactcaaattctgttttgtctgatagaaatatggctactgttgctctcttttggtttccatttgcatggaatatcttttttcatcccatcactttcaatctatatgggtctttatagacaaagtaattttcttgtagggagcatatagttggatcttgattttcaatccattcagccaatgtatgtctataaactgaagaatttagtttatacttaatgttattattgataggtaagaacttactattaccattttgttacttgttttctgtttcttttgtaactcatctcttccttttctttcttcttttattactttcctccttagtggttaaatgattttctctgatagcgctttaattctttgcttttaaaaaagtgtatgcatggctgggcacggtggctcacgtctgtaatcccagcactttaggaggccgaggcaggcggatcacgaggtcaggagatcgagaccatcctggctaacacggcgataccccatctctactaaaaatacaaaaaattagccaggggtggtggcgggcacctgtagtcccaactacttgggaggctgaagcaggagaatggcctgaacctgggaggcggagcttgcagtgagctgagatcgtgctactgcactccagcctgggtgacagagtgagactctgtctcaaaaaaaaaaaaaaaaaaatgtgtatgcattacaggtttttgctttagggttattaggaagattatgaaatgttcataagaagttattttcaacaaatgacaacttaactttgatcacaaagaaagtagaagaagctaacaatgacagaaaaacctaaaaaactctatactttaactccctcccccccaacatttagacttttttgatctcagtgtacatctttttatattgcctatctcttaacaaattgttttatttattatttttcatagatttgcctttaagtattcatactagagatatgagagatctacaaaccacaattataatattagagtattctaaaattgtctgtgtacttacttttaccaattggttttataccttcagatgttttctttttgcatgttggcatccttttcttaaagactaaagactttccttttataattttgtattaagacagacaggtctggtaatgaatttcctcagtttttgtttgtcagtcacaacctttatttctactcaatatgtgaaagatagctttgctgggtgcagtattcttggtgggaagattatctctcagcctgtgccccagcactttgagcatatcatccctctccttgttggtctgtaggatttccactgagaagtttgtagccagatgatttggagcctctttatgtttaatttgcttctttctttttgctgcttttagaatcctctctttttcctttgagagtttaatgaccgtatgccttatgatagtcttttttgtgttgaatctgtttgataatgtttaaccttcctatacctagatatttatatctttctctatatttggaaagttttctattattatttatttaagctttgtagcccttgccctctctcagctcccttttgaaggtcaatgacttttagatttgttcttttgaggtattttctatatttaataggtattcttcattctttctgttattgagagtctgacagctttctgctaggcagtttatttctcagttccagggtttctatttgctttttagaaaacgattttgatatacttgctaaatttttctgatacatttctgaattacttttctgtgtcattgcaaagcttgctgaatctcctaaaaactgctgttttgaattattgaacattgccatcttcttagggttggtcactggctcctttgtccattggggctggtcatctttttctgtttgctgttgtttcttatgcaacatcaggtataccgaagactaaaggatgggctgccatgtaccaggcctccatttcttaatctctcaaatctagataattgtctcctacctcatgtgtggtagggaaagcaattggtgtgatgcctaacacaatggggacaatgaatggatattaaccaatattgccatatttccttgatcctaagatggtagctgtcttatattatttttttctttccataactgaatacctaagactgggtaacttacaaagaaaatacatttttttcttacaactctgaaggctgggaaatctgagatttagaggctgcatctggtgagggccttcttgctgataaggaatctctgcagtcctcagttgtgcagggtatcacatggtgaggcgggacacactgagaggaactggcttttacaacagactcacagcagactcactcttgtgacaatctactaacacgttaattcatgaatgggttaatccattcgggggcatagagccctcagaaccccatcatctcttaaagaccccaccttttaatagtgttatattgaggagtaagtctcaacatgaacttttggaggacatactcaaattatagtaataccaattacataattatagaagtttatcaaagtaaatcaaagcaaaaccactatcagattacatttacacataggtgtaagatgcatcaaaagtttcaaaagcaaggctgggtgtagtggctcaaacctgtaatcccagccctttgggaggccaaggcgggtggatcacctgagattgggagttcgataccagcctgggcaacatggtgaaaccctgttactactaaaagtagaaaaaattatctggatgtggttgcatatgcctgtattcccagctacttgggaggccaaggcatgagaatcgcttgaacctgagaggctgaggtggcagctgcctgagatcacaccactgtactccaccctgggtagcagagtgagactctgtcaaaaaaaaaaaaaaaagaaaagaaaagaaaagaaaaaaaaacccaacaacagtttcaagaatttaatctgtgaaaaacgtgatatagaatatgatagaactaggatattattaaagtccttctaaagaactggaacaagattgaaatacagagaagacttagaagattgctcagtaaaactgaaggtctaatgtgatggttaattttatgtgtcaacttggctgttttgcagtggaccagatatttggtcaaacattattctgggtatttatgtaagggtgtcttattggatgtgattaacatttaagttggtggactttcagtgaattaaattgtcttgcataatgtaggtggtcctcatccaaccagctgaaggcttgaatagggaaaaggttgaccttccctgggcaagaaagaattctgccagcagacaggctccagagttgaactgcaactttgactcttccctgggtctccaggttgatggcccatcctgaagattgttgacttgctagctccttagtcacatgaggcatttacttaaaacaaatctctctatacatacacattcttttggttctgtttctctggagatccttgatcaagacatacagtttatgtagacacttcatttgtgtggtcacctgaattttgtgcagcagagaacaggaagatctgcagttagactgattggggttgggacatgagaatgaggatgtgtgggatggaaagatgaggagatatatgaaggacatggttaaaatgagagtgaagtgccttttatcacacctttttgtttaggtccatgctgagccaagaatttccatgaacagaaaaagcttcccgttgcctgaaggaagggtgaagaacatcttctgtctatcttggtttttgcataacttgctgtcctcctgaccagagacttgatgctcactttaatagctttgggcccgaggaaacatttattttgtttcttactgtaagttttactcaggatagtagagagtagggtattctcccccatgaccttggagtcctactccatggaagttattcatattgcttgatcactgtgctaatataagacaagagtcttagcttcaagggaaaactggacattgaagagatctgcctggaaaacctagggttgtttatactgtagcttctcagaatggagcagcagagcctctaacaaactcccacgctgtaactgatgtttacataaagactgatgaagaacaggagatgctattcaagattcttataaaaacagaacccattggcccagcacggtggctcatgcctgtaatcccagcactttgggaggccaaggtggggagatcattcaaggttaggagttcgagaccagcctggccaacatggtgcaactacatctctaataaaaatacaaaaattagctgggtgcagtggcacttgccagtaatcctagctacttgggagggtgaggcagaagaatcacttgaacctgggaggcggaggttgcggtgagccaagatcgtgctactgcactccagactgggtgacagaggaagactccatctcaaacaaaacaaaacaaaacacccaaaaaacaaaaagcagaacacatcaaaaagaaagggcagagaccaaccgactaatcaattttggctgtgagtaaagcagttaaatagaggagcatcacagtgacttttaggcaaccaggtgggacctggaaaatccttccctttcaccctacacaccaacctgacctaagttcacagactttgtagagtgaccttaacttcccaaaagatgtacttgtatagagcatctgaggtctccccactccccattctggttcctgctgtcggagaccctcacctcttgggtggtgcatgagaatgctcgccttcctctatcatgctctcttgctggccctccacttccaggaccaggtgtgacagcaaaagtggaagagagtcctgctaagaaaggttgctgaggcagagaaccagcccctaccacctatctcccagtaaagtggagagctctcaccaaggaccatcagatgaggaaaggcagcaccagcctgcactagcctggtaggttctttaatattggaaggactttggggcacagagaaaaatctcaccactatttacactaagtttaaaccagttcttgagtattaaatattgatacaaaggtgattatttaaattcccttcatctatattgatgtaatacatttagtatgcctaattgtttttaaacacatctaataccttaaagaatagataaacatattcctgaaagacaatcacaaacttattcattcattataccaaaaatgatacagaagggcccatatcatggatttgacatcttttctcatttgttttgagtttactccttcctatgatttttgtgatcttccgagaccccaaatgactaaacgaggttgcaagtctagggccaaatagctgacccttgatcaggaaacagtgctttgcatgtgtctaagatgaatcaaacccagactacttgttatttattatcaggctgagactttttgttgttgttgtaataaaaatgtttggttttttttgtcatgtcatgacactgttcaatccctgtcttttatataaattttaattctagaaacttgtttttctcacaaatacgtcgttcttaagtttttgcatagccctaagtgtatggccaattttcttatcattatgatgtattgacttggttcattggcataattaaaaacatattaacatatattttctcactagcattttattaaaatgagtatagctttattataataaatagagttcatatgcttgaagggatggagagttgagaccaactccttcattaaacattggtctaattaaccttttggggaccagtgagggaccatttgtctcattggttattgggcctcgtcctctatggtcaccagcttctgagctcctcttctatctggttattaattgagatcactgatgcttgtcagtctttcttgttttgggcacagttttaactttttccttagtaaactttattttattctatcttgttgatacagttatatatcaccaaaacagagtgaaataaagcttaatgtaaagtgtatatatttaacacatctgcttaaaatttcaaaaattatgtatagcaatgctttcccactttttaaaattaaaggacaagtaaacatagcccattagatctatctttcctttgagccaacaaccactttttgcctctcattgtaaacttctactttttgagtatcattaggaatgcattgaatttttaagtttcaaactattccaattaacacttatatcctgtcaggaatggtggctcaagcatgtaatcctagcactttggggggctgaggagagcagatcacttaagctcaggggttcgagaccaacctgggcaatatggtgaaaccctgtctctacaaaaaaatacaaaccattagtagggtgtggtggcacatgcctgtagtcccagctactcaagaggctgaggtgggaggatcatttgagcacaggaggtcaaggctgcagtgagccgagattgcaccgctgtactccagcttgggtggctaagttagacactgtctcaaacaacaacaataaaaaacccaattatattcatttttgttattttgttattgctctatgatgctcaaattgtgcatcattggaatgcaaagaccagttaacttaatgtagatcagaattctcaatacaaaggaaccatacaaaccaccatataacaaagcaaaagaaaaaaaaggaaaaagaaaagaaaattaaaaaggtcaaacacactaagtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatgtgcaagattgatgtctcctacctgaggttctaagagcagagagtccatttcctgcaaaggagatagcaaggtcctggttgtcttccccagactgcttctgggttgtagcctcatcagctctttcctggagtgactcagcctgggcctgcagggccaccaggagaatggcagcaaggatggcgatggtcctcatggctggggtcacctgcaggagggagagcaggagtggatatgtggggagtgaggagtcagcctggatttatagctctgctgggagaagacctgagacagaagctgcagtgagaggaggtgggcatgtgattgggaggggaaggactgcctttgttctcaagatccctttgatgctcctctttctcccagctttcatcaaagcgtgagtctgtatgcttaatgcctcttcttgatccaaggtgttaatgatgataagggtattactatcctgttctgtttcccatctgcttgagtatttacttttatatattcaaaaaagaaaaacaacagcgctttcattcaagaagtttggggatcaaatgcctcttgttttctgaagatggtccctggtactctctggatgactctctgggggcagacctgggactcagtggagtagagagttaattcattgcaggattcagggatattactaacctcatgtaggaggcttttgagatctcgaggtgagtagtctcccgctggtgccagtatggagaggtcaatgaccttatcaggctataggggaaatgagttcagtaaaatagtaggccaagtttatcagattaaaataaaaattcggatttagttcaaggagttggtgtgatctgaatgcatcacataaaatgtgtagcgggtacttctctccactttggggaatatcaaagtaatttaggtgcgtacagcccctttctgagattttttttttagttttagaaaattgtaaatcatgcacaaggaacaacattcaaaaggtagaagtcatgagctctcatttctacccccaggccttcagttctgacccagcaaaccatcactattaacagttacacatagtattctgcacttcgcttttttcacctgtaacattggcactttgtatatcaaaatacatggaatgctattataattttaatagccttatactatcccagggtttgtatatgccatcacttattttttgtactgataaaatattataaaattattacaatttggttatttttaaacttttgcagtaataagtaaagttacagtgattatcttgtatatatgttctcttacctatatggataaacttatagaaatagaattgctgtgtcaaagaatgcatcttaagccagcatggtggtacatgcctatatttctagctatttgagaggctgaggtgggaggatcactggagaccaggagttcgataccagcctaaaaacatagtgagacccctttctcttaaaaaaaaaaaaagagactatatcttacacatttttaagatattactacatatttccataatatcaccatatttgatccaaatcctttggggctcagtgggcccttggagagtctctatatttgaattcctcatttaatttttttcaaatttatttatttattcattgaaaaataattttctgtatatttgtagggtatgatgtgacgtttggattgatatccacatgggagaaacacataagctaattaagatagccatcacctcaccaacttaattttttaaggagaattacaaattgattcctttagcagtttgaaagatacaatacatcactattaactgtggtcaccgtgcagtgccatagatcactaagactctccagcataactgaaactttgtactcttggctcaacatcttctcttttcctatctcacccacctgcagcttctgatgaccacctttgtactctagttccataaaactgacattttaacattccatgtgtaagtgatatcatatagtatttgtcttcctgtgtctggtttatttcgtttagcacattgtcctttggttccatccatgttgtcatgaatgaagaatttccttcttttttttttttttttttttttttgagacggagtcttgctgtcgcccaggctggagtgcagtggtgcgatcccggctcactgcaacctccgcctcccaggttcacgcctttctcctgcctcagcctcctgagtagctgggagtacagtcgcccgccaccatgctcggctaatttttttgtatttttagtagagacggtgttttactgtgttagcgaggatgatctcgatttcctgacctcgtgatccgcccgcctgggccacccaaagtgctgggattacaggagtgagccaccgcgccctgccaatttccttcttttttaaggctatatggtataccatcttgcatgtataccatattttctttattcattcatccactgatgaacatttaggctaattccatatcttgcttattttgaataatgctgaaatggacatgggagtgcagattcttctttgatacagtgatttcaatttcttgggagatatacccagaagtgggattgctgggtcatatggtaattctatgttcagtgctttgaggaaccgccatactattttccaaaatggctgcactaatttacatttccaccaatggcctacaagggtccccttttttttatatcctcaccaacacgtattatttgtctacttgttaaaagccattctaacagatgattacctctttatgattttaatttgcatttccctgataattagtgatgtcgagtgtgtttttcatatatctgtgggccaggtttattgcccttttttaaattgagatgtttgttttcgtcttattgagtgtttgaattccttatatctttgggatattagccccttatcagatatatggtttgcaaacactttctcctagtccctggatcatctttttgtttcctttctgtgcagaagttttttagttgatgtaacctccttggtctatttttgattttgttgtctttgcttttggagtcctgttgtagaaataattgcccagaaaaatgtcataaagatttccctccatgttttcttctagtagatttacaatttcgggtcttttatgtaagtctttaatccattttgagttgagttttgtgtatagtgtgggataagtgtccaatttcattcttctgcttgtggatatctagttttccttacaccttttagtgaaaagactgtcctttccccattgtgtgttcttggcatctttgttgaagatcaagtaatcataaagccctgggtatagttttgggctttctactcctttcctttggttattgtgtctgcttttacaccagaccatgctgttttgcttccaataactttatgatacattttaaaatgagagagcatgatgccgctatctttgttatttttgctcaagattgctttggctattcggggtcatttctgatttcatgccaattttagtatttttttaattcctgtgaaaaattgcattggaattttgatggggatctacagatcactttgggtagtgtagacattttaataatattaattcttccaatccatgaactcaagatatctttccattcatttgtgtcttcttcagttttattcatcaatatttatagttttcagtgtacagatctttcacttttttggttaaaattacttctaagaattttatttttgagtgctattataaatgagattgtgtgggcttctaaacctttgtgccagtccaaactcctgtctttattcttagtgactcctacaaaattagaaagtgtcaagtcatgctattgccttgagagagtgggagagaagccagacctttagaatacagtggagaggttggggtgtttgatatgtgtttcagttttttctttctttgcagagaaactgatagagtttatctcccacttattctgccttatgaaaatgagaggatctgaattaaatctgtaatatctataatatttatttgaattcgtgaattaacagggagcctgggagggactaatttcctgcatcagtgattccaggtttcatggcccttgttttgccctggtggccatttagcaccaggttttaaaccatctgtatttgtactgcttctctatttctcactggacattgctaagtttgtagatagcgttccacaattgtttcctagcctccgtctctctggcattgtctctctgaatctctagcaatgactgaagaaacaatttgggacatttttgttccagttctaacctttctccatgaattctctcatgtgtttgatcacccagagtccttattatttggagaaattgatatcttcagtctctcttcatccttctctgaccccaaaattaattgggtgagcagaaaatctggaaagataaatgggtggtttaaaaaccactgtccaggccctgtggtgtgagaggcagagctgagcactggccaagccagaagatgcccggtggcccatcttcccaggaccaggccctcaccggcagcccattgctcagccttagacacaactctgttgccagtcaagtttctcattatctctggcagaagtatttctagagaactccactgggctgggcgcaatggctcatgcatgtaatcccagcactttgggaggccaaggcgggcagatcatttgaagttaggaggtcgagaccagccttgccaacatggtgaaactccatctctactaaaaatacaaaaattatctggatgtggcagcgggtgcctatagtcccagctactctggaggctgagacacgagaatctcttgaacgtggacagcagaggttgcagggagctgagattgtgccagtgcactccagcctgggcaacaaagcgagactccatacccccaccccccccaaaaaaaaagaaagaaagaaaaagaaaacggcactgacattatggaaaataattttagtttcttaatgcgtttgtaaataatcatttagaataaaatgcctttcctgttcccttttttctttaactgtagcaaagtgcccattatctattgtccccttgacttcaaacgtgctgtcatttaaaataaagtctgaaaaactatttttcttgtcctttattctgagtccaatcttgcctctcctatactcagcgctgggacaaaaacaggatttccatccataatatggacattcactcttaatttccatacataatatggacattcactcttagaaggcatgtactccctgggcgatgatttaattatttaacataaaaattaatttaactgtgctaaaaactaaagggcaagggaattggcctgaaagaaaatacttcagatagcaacagaatctggttttataatagaggttttgtattccaggatattccaggggacaaacaatgcttagatgtgtgtttattactggtaacagtcaagcagatgggagacagggagagtgataggggccttcatgaacgtgaagagcaggtgtttcagtgcagctgctggattggagaatcatcaaaggtctgaaccatcaacccaaaggatacctctatcccacagccacgcaggtttggggtagctcattgccctgggatgctgcttcctccagatatcacagagctggggtctttttactccccttggtcctcaggctccttcggtcccttgagagacagtgacctctaggaggctcacagccctgagagcctttccccttgtccttctctggagcctcttggagaaagctcaccaggtcctagccttgcagcagcctgggacagaggacccagatgtagctgtcccctttgcaggagtgaaaactgcattatgggcttcgggtaagacaatgtgctgtctgttgggagctgcagtctcagtggtgccatcaactagctgtgggatcattagtgcatgacttcacctatcatggcctctgtctttcaactctaaattgggggcaatagagtctctccaaggggtcttgggtgcaagaccttgaaacccttgaaagattaatgtatgcagttcatcccgcaggcacgagcagacaactaggcaacaaataacagccacttaaagctttcttagcctaagctgctttcagaaacagcctgtcaaagtttctccaggctctacggtgcctttgaatatcacatttttaaccccaaagtccatgtaattcattctggcaatcacccaatattattcaaatttcatgtagttcattcaggcaatcacccaatattactgaaattttaatcttctcttagaatactcattctccatgaaatcttttccaaatgtatagtgctaaatgctgtcaatttcagaatgattcctgcatttatatcttcagctccaaccacccagctgaattccagactctggaacacatttcctgtcgtgtgcgctagaatctccaacagattcctcacccctaatgtccaaaactaaactcttcactgtacatctccccagcttgcaggcaccacacacacatacaggtgttgtcatttcagaaaatggcaccagtgtctctgcagttgttcagggcaaaaaataaaaatattcttcagatatcctaatattccatattcttacatcagcaacttctgttgcttctgtaccttcaatataaattttgaatggggccatttcttatcccctgcactgccagcaccctggtgcaatatacactggcttctcatctgggcttcctcagcccccttgtaactgggctcccgctgatactgggctctgtgctgcctctgagcacccgttttccagagctggtcaatacccctgtctagcgaggttctttcccagccattttcaagatgcaacacccaggtactaagtcctgacaggcactaatctccacggttctccaggaatgaacaaataagggaataaccacacatatcccatgtatccacaaacgtagtgcctttttttttttttaaagaggatgggtagctcattgtcctttcttaaagaagcactacgtttgtggatacatgtggatacatagcatgtccccaaagctatgctcttgcaattggtgtccagcagcctctgaacaagtgaggaaggttcatccaatagtgcaaaactgggctgtaggtgcccaccaggaggagccagaggtcctcatgttcatgaaggcccttatctctctccctgtctcccatctgcttgactgttaccagcaataaatatggtcatgtctaaccatcatttgtcccctggaatatcctggaatacaaaacctctattataaaaccggattctgttgctatcttattttcttccaggccaattgtcttgcacattactttgtaacacagtcaagttaattcctatgttaaataattaactcatccgtcaggggagtacatacattctaagagtgaatgttcatattatggatggaaatcctgtttttgtcctggccctgagtgacctggacaagtagatctttctaccctgagatccagctcctcagggtagaaagtgcagagctgacatctctatgaaaatgaccagggcaatagaaacaaaaaggtaagaaaaaaggtaaagaaaaaaataaggtaaagaaaaggggggactacatggcccaaatacattgagcttactgtgaaaactcatttttggagatagagagaagataaagaacaaggaagagagactaaattgttcgtttccaggttttcaaatggaatcttgtcctgatttgggtctcaattaacaaagcacaaggacagctgagcctgtaacaggtgttgctgaggatacaggaccgagagtgatactcagtggcaacatgcaggtctgcaactgcaggtgcctctcacctggtgacctgcaggaagatggaggagcatattgggcacagtgctcggtttgggggtacgggaaatcagatcagagcagcccagaggaggactgtgttctaatagagcaggttctaatagagcagaataaagagatcataactggccatctgtcggccattcaagatctggtgcttcctttcatgttttctgtcatttatatcacacagtccccactccctgcacacaggcactgagactcagagacatgcacatgcacgtctataacacatacatccccagtttccacctcacaacacactccactcaccacacaggcgtgcacatacctgcacaatataaacatacaaacatatgcacaggtgcacgcatgcacacacaccctgaagtgcagactccaaactctaatatatctggtttagtctctgaggctgaagctgctcagagggcgcctcccgcgatgcggggagtaatatctccccctctcccccccgggctattaccagccacatcacaggggggtgagggcgccccccgcgatgcggggagtaatatcgcccccctctccccccttgcatattacgagccacggtggtcacacagcgtgttgacattattgtcaataatatcttctctccctctggaaatgaccaactagatcacagaccggtgtacatcctcttcactatttgtagtaatagcatcctcttccccctggatattaagaacagtatcacaggagtctttctacccccagcggcattgggtgtagtatcgtcctctcccacgttgaaattatgaactatatcactgggggtgtgtccaccccatgcgatattgatagtagcatcatcctcttctctcctggatcaggggagcaatgtcactggggtggtgtacactttctgcggtatcggcagtaagatcatcctctccgccttggaatatgaaggaccatatcacaggggggctgtacacaccctgcgctatgaagacgaatattatcctctcccaccctgcacatgagaaaaaatatcacagggtgggtgtacaccttctgcgatatgggggggaaatatcttctcttcttctggatagtaggaacaatatcacacgggtttgtacactttctgtgatattgggagtaatatcaacttctccgcctttgaatattaagaacagtgtcacagactggatgtacaccccctgcgatattgggagtaaaatcagcctctcctctccatggatattaggaataatatcccagaatgggtgtacacctcctgctgtatgggaagtcatatcttcctctcccttcctggctactaggaaccatatcagagggtgggtgtacacagcctgcgatattgcgagtaatatcaccctctacccctccggatattaggaacaatatcacagaaggggtgtacactttctgcgatactgggagtcatagcattgtcttcttccgtgaatattaggagcaatttcaccgggtggatgtacacccactgctctattgggagtgacgtcatattccaccccctggagattatattcggatcaatatcactgggtgggtgtacacctactgcaatattgaacataatatcatgctctctccctccctggacattaggagcaatatcacaggtaggtgtacacccactgaggtattaggcgtaatattcatattcattattcctcatttattagtcacatgaatatgaattaccaatattaatattaataacaaattgctgataaaaagtgttcaaaatattaatattaattattaggagctaatattactgttttctaatgtataagatcaatatcagttattaatatcaggcattattaatcattaatattaatcatttattgttatcattcgtataactatttaatattaattatcattattattggtattgatgttaaaaattatattttcagttattaatgtcgataattattagtatcaattaataatggatgttattaattgcgataagtaatattgatattaaaatcgatattattgattatcaattattaattgcgataagtaatattgatgttgaaatggatattatttattattaattattaattgcgataataatattaattgcgataagtaatattgatattgaaattgatattattaattgtgacaagtaatatcgatattaaaatggatattagtgattattaattattaattgcgataatgatattaattgcgataatgatattaattgcgataagtaatattcatattaaaattgatagtattaattgctataagtaatattgatattaaaattgatattattaattgcgataagtaattttgccccattccacataatatctgtgatcttgttgctaatacccaggcggggagaggacgttattaatcccaataatccggaaggtgtagacctcccctgtgatattgtccctaatatccaaaggtggagaggaagatatacctcccaatttcgcaggggttgtacaccacccctgtgacattgttcctaatgtccaggggtagagaaaatgacatgactcacaataaggcagggggtgaacaccccgtccatgatattgttcctaatattcaggggggaagagtatgatgttactcccaatatcacaggcggtgtactccccatatcccaggttgtggatagtatcccgatctgtgatagactccgccacgatgtggggagtaatgtcatccccctctccttccctcggtattacgatacacatcgcaggggggcgggcgacccctacgatgcggggagaaaaatcaccccccacccctgatattacgagccacatcgcaggggggtggacacccccagtgatgcggggagtaatatctatcccccttccccatggatattaggagccacatcacaggggcgtggacaccctccgctgatgcgcagagtaatatcaacccccatccctccctgcatgttagcagtcactgaggacacacagtgtatttaccatatttccagtaagatcatcttttcaattgaaccttatgaacaagatcacagaggggtgtacacttcctgcgatactgggggtaatagcgttctctcctccactgcatactgggaacaatatcacaggggtgtgtattcctccttccatattgagagtcatatcatacttgccttccatatattaagaacaatagcaaagaggggagtggacactgtgacgatattaggagtaacatcattctctctacccctggatattagtagcaatatcacagggggatgtacatttcttgtgatattgagagtagtagtattgtcttccccggtggatatgaaaaacaataccacaaggggcgtcaaaccacctgccaaatttgagggcatgttatcctctccgcccccggatattagagacaataacacaggggtaatgtacacccactgcttgatcgggagaaggatcatcctctcccttcttggatattaggaacaatatcacgggggtggggggggggtgtactgcctctgcgatattgggagtaaaactctcctgtcttcccctggatattaggaagtgtatcagagggggagggtgcacattccctgcgatattcaatgtaatcttatgctctccctcccagggtatgaagaacaatattacaggaggggtgtacaccctctgcgatattgggagtcatatcatcctctttcgctctggatattaggaagaatatcacagggctgtgtacaccccctgtgatattgggagtcatatcatcctgtggccctgaggagagaaacaatttctctactgtctcctgtctctgaagaggaggaggaagtaaaagtgggaaaacaacaggaatgaagtcagtggcaagaccagccggtggcactgatgagccggtctgcggtgaaaagattaacccccccttagattaaccctaagcacatgtgctctgaatccatcacggccctttcacgtggaaccccttggagttgtaagcccttaaacgggccaggaactctgtcttccttggaggagctgggttcttaagacaagagtctgtcgatactctcggccgagtaaaaaaacctcttgcttcttgaatctgctgtctgagggacttcgtccacggctcatcctacttcatttcttagtgccctgattgggaatcaaacgggggcagcagcggtaaaagcaccgaatcccaaccactagaccaccaggggaactttgaaccttggggaaaatagattgcccaccattagaagtgggtcggccatcagaaggaagcctggacaggtcccttgcttctaaggtgtggcacaaggtaactggtaaaggacacctagaccagttcgtatagacacttggtgacagctggtgctagactccccacagtggctaagagggcaggcagcggaaatactagtagcaaagggacagatagctaaggaaggatcccgctccacccgcccagggaaatcaactcctgaagctctattccacccagcgtcagaagatgcattgcaggagatggcaccagagatcccagtggtgccctccccttagcagggaaagaggctccccactcttgagcccacagtgcttgcgcctccgcaagacaagcgtatccctaggccacctagagtagacaaggacttgggagaaacccctcccttggcagctcatttacaacccaaaaccgggatccaaatgcccctgagagagcagcggtagactgctatagttgaggatggtcacgtggtggagagacgtgtttttgggtaccagcccttcacctctgctgaccttctcaactggaaaaataataccccgtcctataccgaaaagccacaagctctgattgatttgctccaaactgttatccagacccacaaccccacctgggctgattaccacccgttgctcatgttcctctttaacacagatgaaaggcggagagtcctccaagcagcaactaagtggctagaggaatatgcaccagctgattatcaaaaacccagagagcacataaggacccagttaccaggaaccgacccccagtggaacccacatgaaagaggggatatgcaaagtctaaactgagacagggaagctctcttggaaggattacagaggggagctcagaaggccacaaacgttcacaaggtctctgaggtcattcagggaaaacaagaaagtccagcacaattctgtgcgagactgtgtcaggcctatcgtgtgtatactccctttgatccccagatccctgaaaatcagtgcatgattaacatggctttagtccgtcaaagcgcagaagacatgagaagaaaactgcagaaacaggctgggcttgcagggatgaatacatcacaatgattagaatagctaaccagatgtttgtaaacagggatgcagtaagccgtaaggaaaaccgcaaagagaatgaacgtccggcctggagaaacactgacctgtttgttagctgcagcaatcagaggggccccccgagagaggcaagggaaggggggccctgggacagaaactctgcttggctgtcagagtttgcagtgtaaccagtgtgcttattgtaaagaaataggacattggaagaacaaatgtcctcagctcaacagaaaacaaggtgactcagagcaggaggcctgggacaaggaggaaggggccctgctcaacctggcagaagggttattggactgagggagaccaggctcgagtgtccccaaagagcctctggtcagaaggacagtctgggatagagacattgattttcttgtagataccggtgctgaacaatcgctagtaaccgccccggtcacccccttatccaaaaagactattgacatcatcagagccacgggggtttcagcaaagcaagctttctgcttgccccgggcttgtgctgtaggaggacataaagtgattcatcagtttctgtacatgcctgactgtcccttgctcttgttgggaagggacttccttagcaagctgagagccactatctcttttatagagcatggctctttgctgctaaagttgctcagaatgggagtcattatgactcttatggtcccccaagaggaggaacggagacttttctgaactaagccgggccaagagataagaccagctctggctaagcggtggccaagagtatgggcggaagacaacccttcaggattggcagtcaaccaaccccctgtactcatagaaatgaagcctggggcccagcctgtgacggaaaaacaggacctggtcccgcagagaaactcttcaagggatccaggtccatctcaagcacctaagaacttttggaatcagagttccttgtcagtctccacggaacactccccttctgcatgttcccaagccacagaccaaggactacaggccggtacaggatttgcgcttgcttcatcaagctacactgactttacatccagcagtacttaacccgtacacattgctggggttgctgccagctgagaacagctgcttcacctgcttggacctgaaagacgctttctttagcatcagattagcccctgagagccagaagctgtttgcctttcagtgggaagatccggagtcaggagtcattactcagtacacttggaccaggcttccccaagggttcaagaactcccccaccatcttcggggaggcgttggcttaagacatccagaagtttcccaccagagacctaggctacattttgctccagtacgttgatgactttttgctgggacaccccatggcagtcggatgctccaagggaacggatgccctactccggcgcctggaggactgtggctataaggtgtccaagagaaaagctcagatctgctgacagcaggtaagttccttaggatttactatctgacacggggaacacagcctgggatcagaaagaaagcaggtcatttgcaatctagcagagcctaagagcagaaggcaggtgagagaattcttagcagctgtggggtttgtagactatgggtctcaaactttgcagtattagccaagactttgtatgaggtcacaagggggcggggactgggaaccgtttgaatggggatcccaacaacagcaagcctttcatgagttaaaggaaaaaatgtatgtcagccccagccctggggctacccgttctgacaaagccttttccattttatgtgtcggagagagaaaagatggcagttggagttttaacccaaactatggggctggggctgaggccagtggcctacctctctaaacaactagacggggctcctaaaggatggcccccatgtttgagggccttggcagcaactgccctgctagtacaagaagcaaataagctgactcctgggcaaaacctgaacatacaggccccccatgctgtggtgactttcatgaatactaaaggacatcattggctaaccaatgctggactcaccaagtaccaaagtttgttctgtgaaaatccccgtataaccattgaagtttggaacaccttaaaccctgccaccttgctcccggtatcagagagccctgtcgagcctgattgtgtagaagtgttggactcagttgattctagcagacctgacctccgggaccagccttcggccatccgtagactgggaactatacatggatgggagtagcttcatcaacccacaaggagagagaggtgcagggtatgcagtggtaaccctggacactgttgttgaaaccagatcattgccccagggcacttcagcccagaaagctgaactcattgctttcattcgggacttagaactccatgaaggtaagactgtcaacatttacactgattctcggtatgcctttttaacctttcaagtgcatggagcattctagaaagagaagggcctattgaactctgggggaaaagacataaaatatcaaccagaaatcttgcaatgatttgaagcagtatggaaaccccacaaggtggcagttatgcatcgcagaggacaccagcgagcctccaacttggtgggcttggggaattcccgcgctgactcagaggctcaaaaatcagcatctgcccccttccgggcatcagtcacagcccctctgctccctcaagcacctgatcttgtacctacttcttctaaagaagaaaaggactttctccaggtagagggaaggacaagtgatggaggaaggatggattcagttaccagatgggagagtagctgtgccacagctactgggagctgcagttgtactggctgtgcaggaaaaaacccatctaggtcaggactcactggaagagttgttaggccggtatttctacatcttgcatttgtcagctcttgccaaaacggtgacccagccgtgtgttacctgccgacagcatgatgggagtcaaggtccagccgttccgcctggcatatgagcttatggagcagccccctttgaagatatccaggtagacttcacagagatgccaaagtgtggaggtaacaagtatttaccagttcttaggtctacctactctgggtgggtggaggcttatccgacacgaactgagaaagctcatgaagtaacctgtgtgcttcttcgagatcttattcccagatttggactgcccttatggatcggctgagataacgggcctgcatttgtggctgacttggtacagaagacggcaaaggtattgcggatcacacggaaactgcatgctgcctactggcctcagagttctggaaagttggagcggattaatcggactatcaaaaatagcattattgtcttctccgctggttattaaaaacaataacacaaggggcgtcaaaccacctgcccaattagagggtatgttaacctctcccctcctcctccaccgcccccatatattagagacagcaacacaggggtgatgtacacccactgctttattgggagtaatatcatcctctcccttcttggatattaggaacaataccacagtgcgtgtatacgtctgtcgtgaaattcgatataatgtcatcctgtgcctccctagatatgaagaacaatatcacaggggatgtacaatttctgagatattgggagtgatatcatcctctcccctctggaagttagggacaacatcacaggggtagtgtacaccctctgtgatgttgtgactaatgtcatcctcccgccccctggatattacaaaccatatcacaaggggcgtgtacacacacttcgatattggtattaataccgtcctctccctctttgggtattcggtgccatatttcaggtggggtatacgccacctgcaatattggaagttctattattttctccccccgtggatattagcaactatatcacagggggtgtgaaaaaccccctcgatatttggagtaatatcggtcgtctcccctcatgaatgttaagaacaatatcgtgagggggcttgtacaccccctttgatatttgatatcatcctgtttccccctggatattaggaacaatgtcaggaagggatgtacagaccctgcgacacttgctgtcatctaattgtctctcccctagatattaggaaaaatgtaactggggatgtgaacagccctgcgatattgggaggagtatcatcctttccccccttgcgtattaggaacaatatcacaggtggggtgtactgcctctgcgatattgggtgtcaaattatcctctcttcccctggatatgaggaagggtatcagagggggagggtgtacattccctgagatattcaatgtaatcttatcctctccctcccagggtatgaagaacaatattacaggaggggtgtacaccctctgcgatattgagagtcatatcatcctctttcactctggattttaggaacaatatcacagggttttgtacaccccctgcggtattgggagtaatatcatcctctctccctctggagattaggaagagtatcacagggctgtgtataccccctgcagtagtgggagtgatatcatcctctctccctctggatgtgaggaagagtttcacagggatgtgtgcaccccctgcgatactgggagtaatatcatcctgtcgccctctggatagtaggaagagtatcacatgggtgtgtacactccctgcaacgtggggagtaatatcatcctctgccccctggatgttaaaaagcaaatcacgggggttgtgcacctgctgcgatattgggagtaatatcttcctctctccgcctggataataggagtaatatcacaggggtggtttacatcccctgcgatattgggagtgatatcatcctctctcccccaggatattaggaaaaacatcacaggggggtgtccaccccctgggatattggtgtcaaaccccctgtgatatcaggagtaatatatcatcctctggccctctggatattaggaacaatatcacggggtagggggtgtacaccgtgctatattgaaagtaatatcatcctctcctttagaaacgaaatcacagtgggttgtacagctcgtgcgacattggtagtaatatcgttccctccttgcctggatattaggaaaaatattacaagggggttgtacaccacctgcgatatttggagtcatatgattctttgcccacctggatattaggaaaaacatcacggcgcgggggtcgtggaaaaccccggctattttgaaagtatcatcccctttttccccggatactatgaacagtatcacaggagggatgtacaccttctgcgataatgggagtcatattatccgctccctccctgaatatttagaaaacgtcacagtggggtgtacacccctgcgatattgggagtaatatcatcctctccatccaggaaatgactaacaaggtcacgggggggtgtactccccctgtgatactgggagtaatgtcgtcctccccaaacctggatgttagccacaggatcacaaagggggtgtacacaccctgcgatattggaagtaatacgatcctctccccccggatattgggaaaaatatcacagtgcgggtatacatttcctacgctgttgggagtaatatcattcttttcgtctctggatgtcaggaccaatatcacagaggtggtgtacatttccttcgatatggggagtaatatcatcctctccctgctgggatattaggaacaatatcccagggttgtccaccctctgcaatattgggagtaatatcatcctctgtttccctggatattagacacaatatcacaaaaaggtgtacaccccctgcgatattgggagtaatatcatactctccttccctggatattagaaaacagtatcatcagaggtgaacaccccctgcgataatgggagtaacattttctctttttttcttttctttttcttttttatttatttgtttatttatttttgagacagagtttcactcttgttgcccaggctggagggcaatggcacgatctcggcccattgcaacctctgcctcctgtattcaagcgattctcctggctcagccttccgagtagctggtattacaggcatgagctaccacgcctggctaacttttttttttttgtatttttttgtatttttactagagaccttttttctccatgctggtcaggctggtcttgaactcccgacgtcaggtgatccgcctgcttcggcctccccaagttctgggattacatgcatgagtgaccgcgcccagccagcacttaacatttttatttgacatctgttgaagttatagatttatacacacattgattgctgttttattatacactcgcatatacataagatgggaaatagaaaagaataaaatgggcacagtatccctaaagtttcacgttctgagacattttaaaactatatgctttttagaaacttgtttcaattaagaaactctggtatacacacacaatgaagtattattcagcctaaaaaggaagaaaatcctcttcactgcagaaaaaatgggtgagattgtaggtctctatgttaagtgaaataagccaggcacagaatgacaaatattacatgtcctcacttctttgtaggaacaaaaaagaaaatcttgcccaggtgtggtggttcaggcctgtaatcccagcgttttgggaggccgagtcgcacggatcacttgaggccaggagtttgagacccaccctgccaacatggtgagaccccatctctactaataacacaaacaatgagccgggtgtggtgacgtgtgcctgtagtctcagctactcggaaggctgaggcccaagaagcgcttgaacccgggaggcggaggttgcagtgagcccggattgtgcctgtatactccaacctgggcaacagaaagagactccatcccacacacacctacacacagaaggaatctcaggaaggtggagagtataaagggggttagcagacgctaggaagaaaaggggtgggatggggaatgaagacaagtggataattgggccccaaaatacagaaagatggaataaatgagttctagtgtttgatagtacagtatgaatattttagttcacaagaatttcttgcatatttccagatgctttggtaagaagcttcctaactttctcattatgctggtttttaagctcttctctttctgctcttgatatcgtgctggtttttttgtttttttgttttttgttttgagatggagtttcactcttgttgcccaggctggagagtaatggtgcaatcttggctcaccgcaacctctgcctcctgggttcaagcgattctcctgcctccacctcccgagtagctgggattagaggcatgtgccagcatgcccagctaatgttgtatttctagtagagatgagggtttctctctgtcggtcaggctggtcttgaactcctgacctcaggtgatccacccgcctcgacctcccaaagtgctgggattacaggcgtcagcgactgtgcccggcacatgctgtatccttatctgttgtctgttgttgtttgtttgtttttgagcccagaaataacttctcacctatatgttcaaatgatttttaacatgagtgctaagaaagctcattggtggaaaagcagccttttcaagaaatggtgtcggagaaacttgatttccacatgcagaagaatgaaggtggactctaagtcacaccaggtgcaaaaattaacacaaaccagatcaaagacctaaccccaagcactaaaagtatcatatgcctaaaagaaaacattggccacactttcatgacatcagattgggcaatgctctctgggatatgacaccaaaagcataggcaacaaaagaaaattagattccttggattacatctaaatgacagacacttttgtgcagcaaaatcacggcaaactgagtgaaaagataacccatggattaggaaaaatatttgcaaatcatatatctgaaaagaggctgatatccatcatatataaagaatggctagaactaagcaacaagaaactcaaagcatcccatcaacaatggtcagaagactcgagtagacatgtccctaaagaagatatcacaatggccaataagcatctaaaatgatgttcaaaatcactcatcatagggaagcgcaaatcaaaccaagaatgtgataccacacatcaggatggatatgataaacaaacaggcattggtgagactagagggaagtaggaatgctcgaatatgatcggagggaatgtaaaaccgtgaaggaacggggaaaatagtatgatgtgtactggaaaaatcagaagcagaatgatcagatgttcccgcagttgcatttgtgggtacctaccaaaaacaattagaagccaggagtgtaacacagatttgtgtacacccatattcatagcagcattattcacaacagccaaaatgtggaagcaacccaagggttcatggacagaaaaatggaaaagcacactgcagttcattcataccgtggaagactattcagccttcaaaaggcaggcacttctggccggcgtggtggctcacgcctggaatcccagcatcttggaagaccgaggtggatggatcacctgaggtcaggaattcaaggccagcctggccatcttggtgaaaccctgtctctaaagaaaatgcaaaaaattagatgagcgtgggggcatgtacctgtagtcccagctactcgggaggctgaggcacaagaatcgctcgaacccgggaggcggaggttgcagtgagcccagattgtgccactgcactccagcctgtgtgacagagtgagactccatgtaaacacaaaacaaaacaaagtcaaactaacaaacaaacaaaaaacaaaataaaaaaaaacagacaggcacttctgatgcaggccgcaacatggatgaaacttgaagacattgtcgtcagtgaaataaagaaatcccaaaaggataaacacgaccaggctcagtggctcacacctgtaaccccagcacttcgggaggctgaggcaggcggatcacttaaggtcaggagttcaagaccagcctggccaatatgatgaaagcttgtctctattaaaaatacaaaaattagctgggtgtggtggcacacgcctgtaatcccagctactcaggagactgagacacaagagtcccttgaacccgcgatgtggaggttgcagtgagccgagatcacaccaccgcactccagcctgggtgacagagaaagactgtctccaaaaaaaaaaaaattaaacacggtatgattccacttatctatcaagtgtctagagtagttaaactcatagagttgcaaactagaatggtgacccccaggggtgggtgagagagaggagtggagaggttggagaatgggtgcaatttccattttgaaagataagactctttcagagatgatggcagtgatggttgctaaacaatgtgaatgtacttaatgtcattaaactgtaaactgaaaaagagtggaaattgtaaatgtgtatactggccattctatatgaactaatatatatttataatttttaatatttatacgtggtatattttcccataataaaagatgaaaattaaaacagttggatctttaaaaagaaaagaaagaagcgaataatacacaccagctttctcctgattagaggaagagccccaaagcttctatgcacattcacttttctcttcttcttcttgcattattatgaggaaattcttagaggttggggaacttgagcgactttggctaatgaggagctctgtgccttgagcccccgaggccacagaatagtaaatattcagtctgtgcctccagccctgcagtgtgaggttccagtcctgtgggctccacacccatcacctgtattaggaggctcatgtctcaccctgtcttctggccagccttgaggacggagtctgagcctcaatcgtgcaacacccagggaggacagtggacctgttctctgtggtcatggcccagcagaggggaagggcagttcagtgagtgtagggaaaagaaagagagatcagactgttactgtgtctatgtagaaaggaaagacataagagactccattttgaaaaagacctatacttttaaaaatcactttgctgagatgttgttaatgtgtagctttgccccagccactttgacccaacctgaagctcacaaaaacatgtggtgtatgaaatcaaggtttaagggatctagggctgtgcaggacatgccttgtgaacaaaatgtttccaagcattatacttggtaaaagtcatcgccattctctcgtctcattaaaccaggggcacaatacactgtggaaagcggcagggacctctgcccttgacagtggtatattgtccaaggtttctccccatgtgatagtctgaaatgtggcctcgtgggatgagaaatacctgaccgtccccctcctgacacccgtaaggtctgtgctgaggtggattagtcaaagaggaaagcctcttgcagttgagagagaggaaggccgctgtctcctgcctgcccctgggaactgaatgtctcggtataaaacccgattgtacgtttgttcaattctgagatgggagaaaaacctccctatggtgggaggtgagacatgtttgcagcaatgctgcctttactccactgagatgtctgggtggagagaaacatcaatctggcttacgtacacgtccagtcatagtaccttcccttgaacttcattatgacatagattctattgctcacatgtttgttgctgaccttctccttattatcaccctgccctcctactacattcctttttgctaaaataataaaaacaataatcaataaaaactgagggaactcagaggctggtgccagtgcaggtccttggtgcactgagcaccggtcccctgggcccactgttgtttctctattctttgtctctgtgtcttatttcttttatcagtctctcatcccacccaactagaaatacccacaggtgtggaggggcaggccaccccttaaagtgagtgctgaggggcggtcaggaggcttgttttctttcctcctcatcaggacaaacaggagagtgcggtggacagatgggaggagatcaatgtgcaaactgtctgctcagcagactgtggagtttctgttcttctttgtggtggggtctcagaaatcttattcaaaatgttgctttcctcccccactggttgcctttttcacagacatctcacccatgatagcagggaatgagtccctctaaactattccctcagaacaacaaaaagatgatgaaggtgatgatgaggataaagaggatgatgacagacaccatggcatcatgaacccttactgagggcttcctaaaggccaagctctgagctctgtgctctatgcagcttgtttcatttcatctgcatagtctcccagttattagtgcacatttcatgataattttacagactagaaaaggagcaacgcattttcatagaactcgtaccagatcatgaagtcaaaaagggtgaagtccaatttgaaccaggcagtctaagtccagacacatggcatttggccagtcctctccctgcatccaacctgccctctcaaatccttgtcactcaggcggttgcccctgctcactgtgcccttccctttgggggttccttgtagaccacagctagaccagtgggtgccgcagtcactgtgtcaagtatggaaaggacagctgagatcacatcaaggattccagaaagaattggcacaggatcattcaagatgcatctctccgttgcccctgttcc

SEQ ID NO: 707 - DNA, 34245 bp, Homo sapiens
tcctgttaggtctaggatgggtaacattttgaccaacagactacatggaactagatgccatgctgttttctgggatcaggcgctagtgaactggtgtctttttctatctctctttggatggtgctgtggtctgagacatttttcctctgaaattcatatgttgaagtcttagaccctaggatgatagcattaaaagaaagggtctttttggaaatgaggaggtcagcatggtggagtcctcatgaatggaatgagtgcccctgtagaagaggtcccagagagctccttcattccttccaccagatgaagacacaataagaagatgttgtatatgaaccaaaaagctggttctcaccagacactgattctgctgccaccttgatttggacttcttagcctccacaggggattccgaatggtggcagaagttagggtgtggccatgcggtggagggttggaacaaagaagatgaagggtcactgttgtcccggaggacagagcgctgagaggtagtgagggtgaccttccaggcaatattagagtaacttagttcacgacattttgaattttttttagcagtccacatgtgcttagagggctggtgcctttggagcccagataccatgcttggaggaagactaagcatcccacagggagaggaactgagcccacctgcaaggatgggctagagaacactgagcaaccagctttctaggaaaaaagaaaactctgatttgcaatgtttgtaaatttctgtggttaaaatgctcccagctatagacagtttaagaattatcacacaaaaactcctccctcatgagctggcctgatctgaccccagcacatcacagggtctcatccttcagctttctcagagtttccagctgagccaacaccacctgccacctgtgcacgagtgtcctggccctgaaattttcagatctcagcagaacctctcctcttatgcccgtggaaggatccaaaccccaattgcaaatgtgtgagtgaagacgtgatcatgctgtttcaatccactactttctgtggtgtcttttcgcacagtcctagatgaacagaaggcacggtcttggtgagaagttgaatgtgtgcattttttgtgtgtgtaaatctcagcctctctataatattgttgaagtaggacagaaccctctcaccttatttccaaagtgtcacaaagagcccatcttaatggcagcgtggaattgtggactctttggagtgactgaagaacccccgtcacccattcttagtttaaattcttcctgttcagagcaggggtggtgtgggagccaggtggagtgtcaacctctccccacagtgacagactcagaggaggccacgggacttgggggttggctggaacaacatgggaagaagtagggattttctccaggagattagctacaaaagtcatagagagatgacgatgattcacatggttgtcacctggggagagagcccaaagtaagttcaagagaaacaaagggaaaaaaaaggtgaagacaacagtgtaactcatgctttgatttcttggatcaagcaattcctgaagctagaattcctcctcaattccaagatataggagtcaaaatgttaacttagcttgttgttggtttctgacatttgaattcaagaccccattaagagatctgaaaaacatcaaaaataccagactcagagaacctgaggcaaagatggtgcagtgcacaaggacaggagatgagagcagatgacaagtgtcccggggcagcttgagaccagatgacaggtgtaccaagggcagctggggcatcaggctccctggtgattcccatgcacagccccggggcagaataaccttgttaatgctgatcagcagggaaggaggggcagctatgtgagaggctggaaggacagcaggtgagtcagggatggggagcttcatagttgatgtgcagaaatggaggaattccaggtgatggcaggagttagtgggtggccgtgggtggagggcttgggcaaagaggagggggttcactgttatccaggatctcaaagcattgagaggtagtgagagtgaccttctggaaaatattagagtgaaaaataacttctcataatcttaagtttcttcgtgagttacggggcttttagcagcaaaagacaaaatatgccaaagttcagaaaagggaacaagtacttttcttatctcttacattcttgttgtaaacagagttcagaatatcatataaacaggcacagaatatcaacagcaacaataacgaggcagtatcctttgtttaaaagaaaaattgcaccagatacttttatgaaatgccaaggaattggtgttgaggaatgtcccaataggtgttaactctttgcaatagggagagcagttgaactcaactctcttgaggccaaacacaggagagtttaagccctagggtgagctggtgaaaaagtactggaggttgctggcaggaaggttgagcagtgtgattgggccatctgtgtttcccaatttgtatttatggaaggtaggctcctatcctcccacagagaaaagggtactttcttcttggaaaatgacatttcaaagggttagcttcatatttgacttattctttattttcttctactgtatgagtggcttatttaaggtagaaatatctcactggcattccataaatgtactgtgtgtgtgcattccagtaataagctttgggttttatttgaggctaagcaagttgctcccattgtttggagaccctcacacctctccctgcattctctgtccttagtgtttgcagctgtcatcgcgcaccctagactgcagtagcagaatcttaatgtggttctaccagtatgcctttatcaacacagaggagcagggatattccatcctcgtctgcccctttcccttaaattgatggatgcctccgagaatatcagctcgaattaccagttcatccttttctctttcaacatcaattcctccaaatccagcagacttagaccctgacctggcatatctctgtccctgataccattatctccagcaaacgttcttctctaaccctccttttaatctattcagttgtaaacatctttatgttccggtttaagatacaccataaaatctgtccttgccactccaagacaaaatgatctcttctttctaaagtcctaatgttacttaaagccacattttaccagtgatattctcctatatttcattcttaaaagattttagtttttgaaaggtctgctgtcacatgaactgacatacagaattttttcttctgtaggtttcagctttttttctatgaagttgagtaataataatgcaattttgtaatagtatgtgatgttggggataattaataactcagaattaatttgttgatccccagctatgtgttaggcagtcatctgggcactgtggtacaacaatgagcaaaacatgcagcttcccttctagcacagagagagaaatgttaccgagaataagtgaaatgtataggatgcgaaatggtttgaaatgctacagttagaaataaagagaacaaggaggatggaggtatccaggggaacttgtggcaatcttaagttgggaaatcaagaaagatttcagtgaccaagggatgttttagctgagaccccaggagctggaggagtgagccaggtggacttctgggtgaagggcagctgccccaaaatgaagtgatcctggcccagtggacagttaggaataatttgcagttagttcaaggaccacatgactccaactccaaggcagtgacaggaacccaaggaaggtggcttgtttttcaccccctgaatcataatatgtgtccttcactgtctacacaagggggaagatctgggagcatttattttgtcagacaccaacccactgtgtcctccttgaggtctgcagtaggttccccagctgtgcattgtctcagtggggtgcctggaaccctgagccgcccctttacacaggcagagcctcagtctgggactgagacctgctcggaatctgcatggattggatgtggacaacacctacttccttctcctgggtgctgggcatttgtggttggtgttggtggtcacagctgtgtctagactcattatattgttttattcaagaatggtgaataatccacttgaaacactatttcttcctttgcaaactatggtctctctgtcactgtaagggttcttggggcattttaccagtaccacccaataagagtagccaaggcttgaacagacatatttttattcaaaaaatgtattgtggaatcacaaactagcactactaaatttaaagtaaaataaagactctggggctcacgctagaatacttcccggggctctggggctcacgctggaatccttcctgggcctttgtggtcatgttctcataggctatttgcaggatatgttgaactagtgttcaaggttcaatgggtgcctagagaaggaaagagaagagatacaggaagggtcacatcacacctcagcaagatgtcagcctggcctcagggacaccggtagcgaccctgtcctcttggaggagaggagaaagacaggctcaggaaggtacatacccaacgtgtgctgtgcctggtggggaggctgcagttggaggcaggacaacagggggcgctgtggtcttccaggtaattgctctgagcatctcagagggcgctcaactcctggttcattccctttccgcagacctggtttcctgctcactggctgatgtgcagcactttctgagtatcagaacctcagcgccctgcagcaccagccgggacgcagattacttcgatagcttttccctcacttctgttttcccggtgcccctttaaaactgtattttcaggtagaatcaggtcctctgcagttttaagggaacacaagagtgttaccagatggaagatcttgactgtgagttgtccagattcttagtgcattgaacaaataattcaacaaaacgtacaaacaaagcaacaaaagaacaaagcaacgaaagacaaaccaaagcaacatgagaatgcagtaacgaaagtacagatttattgacacaccacagagtgggagccagttcaagcaagtggctcaagagccccccacttagtgtttttattaagctcaaagaatttggtgtgctgcctaatcttgcctggaactggctgcacctggtgttcttttccttatgccttaacccttgattatcctatttccctattctcctgtctcaagggtgcatctttcagaatacagttgaggaatctgcgttttgtttgtgtgaagacaactttatgaatatgaaatcaagattttccctggcatgggtggaaaatattgatgatgagtctgtcgcagcgaggtgctcctatgcttttcgttgtactcattacaggatttgttttgttttgtttttttgatggagtttcgctcttgtcacccaggctggagtgcaatggcatgatctcagctcaccgcaacctccatttctcaggttcaagtgattctcctgcctcagccttccaagtagctgggattacaggcatgtgccaccactctcggctaatttttgtatttttaatagaggcgaggtttcaccacgttggccaggctagtctcgaactcctgacctcagatgatccatctgcctcagcctcccaaagtgctgggattgcaggcgtgagccactgcccccggtctggaaccatttctttggtgctgggattacaggtatgagccaccacacctggcccattacagctttcttaactgttcattccaatctcaattaaatttttttcaatagagctgtgacaaccccaggtcttcaaaggcagatgtgtgacctgggtctgttcaatgaaactccaacacttcaggaaagaacatggtggttttttccctaagaagtagcgatgttatgattgtgtaaactgaaagctgataatgactgtttttcctaacacatgggagttacgtttgagtgaatccaatcaaagtgaagcagagtgaaaagacagagaagtagaaggagaaattggcagcataatttgtgcttgtaaatcagtttgtgtctgaagccaatgtttgtccttgatattcttagaatttggagttgtattttgcttaaaaagcttaatttaggattctggtgcttgcatcccaaagagtcttgactaagaggtgcattaaacaccaaacaggtacaaacacaaacttgctacaaagactttattaggaataagggaagaaattgaagacaaggtaaaggagtaataaaagttctcctctagatctcaaagcaaatgatgaacacattttcctctgtgctccatgatcccactattggtgcaggtcccatagcggtgtttggaaaaatgacagcctgatattctgccatagcagaccaagcccgtcgctgagcctgaagacacagagaaagcatcaggcattgggactggggtcagacgcggttggtaaggagaatccccgtgcagttacttactgggctgattgcattcatcatggtggccacaccacagcagcagcaagatcagctcaatcaataggaatcaacgtacacagcagtgctgctcacaggcaggattagagacttattctcatttgctcactttttgtgatgctgcttcttcacacacacatttgagtacacccttaggtcccttcccatttgtgaagctcctctaacaaacaaagtgaaatatgtttctttccaagtgggttctcatcctcgatgccagagagactccccagcgtgtttccacatagcataagattactaaatttcactgacttttcacagaatcaaatacctttggaggagcaatgtccattgaatatcatctgattctgtcttttcagtctacacttgaggaaattgaggcctggagaggtgatcacctaagagaaagaaccagctattgggtctgattctagcggtgcctggttttcctctctagactcctggctctgcagtgctggtggctctcacctgaatctctaaaaccagagcttatgtcccctgtgaaggagatggcaaagtcctggtggtctgccccaagctgctcctgggctgcagcctagtcagctcttgcctggagtggctcaagccagggcctggagtggcaccaggagaatggcagcgaggagggtgagggtcctcatggctggggtcacctggaggatggagagcaggagtggatgtgtggggagtgataagccagcttggatttatagctctgctgggagaaggctcagagacagatgctgcagtgagaggaggtggagcatgtgattggggaagggaagggctgcctttgccatcaagatccctttgatgctcttctgttctccgagcttttatcatagcatgagtctgcttatcgagtgtctgttctgggtccaagccaatagtgatgattaggatcatgctataatttcctgtgtctcatctgctggaacatttacttcttaatattcaaaaaagaaaagaaacactgctcttattccataagttcaggcaataaatgcctcttattttctgaagatgagccctgctattcttggtggtctagaccctgaggcaagacctggaccccagcatagagagtaattcattgcaggattctggggcatttctaccctcatgaaggacgcttttgaggttctggaaggcatagtcttctgccactgctagtgtggagaggacaatggcctcatcaggctatcagtcaaataagctcagtgggatactagttaaagagttggtctgaataaggttaaaaatttttttttatttccaaccgtattgagaggagtgacaattagaaattatatcggttgaaagtacacaacctgataattcaacgtatatctacatttgtacccttatctcacaccaaatgtaaaaatcaactctgaatgaattgaagacctaaatataagtcttgaaatcataaaacttactagaagaacccatagggataaagcttcctaacgttgaactgggagattatttcttggatattacattaaaggtagaggcaactaaagcaaaaataaaccagttggagttcatttaactgtaaaacatctgcatagcaaaggaagtcattaactgagcaaacaggcaacctagcaagagagagaaatatttgtaaacgatacatgtaatgaaagtaaatatctaaatatataaagaacttaatagaaaaaaacgagtattaatgataaatgtgactaaacaactaaaagaaaccattattacataattaaaggaaactgtgatgacaaaatcttttcaagggcagaatataataaagtgaagttacgaagaaacacatgaaattctggaattgagaagtacaataatcgaaatgtaaattttatgaacggctgctcaatagtatacttaaactggcagaaccaagatttaggaaatgtgtgtacagatagataaaagattatatagtccagagaacagagaaaaaagatgaagaaacaagaatacagttagagaaaagtgagatactattaggcatgaaaacactcactgggttgagaggtgaactctcaatctgttaaggcagcagtccccaacttttttggcatcagggacatctatgaaaaacttacaactaacatcatactcggtggttgaaaaaaaaaaaaaaggatgctttcctactgaaattagaaaccagccaaggatatctgaaatcagcacttctactcaacattgtgctagaggttctagggcagtcaggcaagaaggaaaaattaaatgacatccaggttagaaaagaagttgttaaataatctctgtttgcaaagacatgatcttttatatatagaaaatccaaaacaatttattaaaaaactattagaactaataagggagtttagcatggttgaaaaatagaagaccagtgcacaaaaatcaattgtattttttctttcataataaacttttcaaaaatgaagctaaaaactccttttacaagtagtatcaaaaggaacatagctagtcgttgaatttaaaaaatgtgcaaaacttatactccccaaaccacaaaaagttgaagtttttaagaatatctaaataactggaaagagatcttatgctcagggattgtgaggtttaatgtgagatgtcagtgctccccaaactgatctacagattcagctcaatctatttcagaatccctaatgacttctttgtagaagactttctttgtagaaactgactaggtgattctaaaatttatatggaatagcaaggatcccagaatagctaaataatcttgaaaaagaagaaaagattcctgttttcaaagcatcctacaaagaaacggtaatcatgacagggtggtactgctgtaaagatagacatagatcagtggaatagaattgagagttcagaaataaaaacgtgtctatggttattaactcactttctgcagtggtgccaagggcattcaatggaggcaagaaaattcttttcaacaaatggtggggtaaactagatggccacaagcattagaatgagttggaccctacctcacactatatttaaaaggtaattcaaaatgggttagaaatctaaatgtaaaatctaaaagcataaaacttttataaggaaacataggggtaagccttcataacctatgtttggcaatggattcttagatattatatcaaaagcatgagcaacaaaagaaaaaaacaggtaattggatattatcaaaataaaaatcttttgtatttcaagtgacactatcaagaaagcgaaaaggcaactcacagaatgagagaaaatacttacatatcacgtatctcatgaaagacatgtatcccatgtatccagaatatatgcagtcctcttatgataaacacttaaagctaaataaacaaatttataaacgggcaaaggatctccttagacatttctctagggaagatatacagatagtcaataagcacatgaaaaaattcttggcatcattatttattaggaaattcaaatcaaaaccacagtgaaataccacttcatatccaccagggttttttagaatcaaaaaggcagataatagacaaaacctgtcgaggatgtggagaaatttactgctgtggtgtaaaatggggcagtctctggggaaaacagttttattgattctttaataagttaaacatagaattaccctgtgagctaggaattccactcctaggtatatacccaaaagctatgaaagtgtatgtccacacaaacagtcatggggaagggcaagaagccagacataaaagaccatgtattacatgattctgtttatacaaaatatccagaataagcaagtctatggggacagaaaatagcttagtggttgctcagaggtagagggatgggaatatcggaagggaggaatggaaagtccttgggttctttatgaagtgatgaaaattaatttgaatgtggttattgctgcacatgtctgtgaatatactaagcgccactgaattctgcactttaaatgtgtgagttgtacatcatgttaattttatctcgatagagtggctttaaaaaacaaaataacacgaaaaatgatataaccaatttttttttaagttaccaaatgcatttcctttctctatatatggtgcactactggtttggggccaaatataaaataaaatatgttggcatgatggaaattgtgttatattgctacattaatggtggtttattatgtgacctggattagtgtaatctgagagatatttgtcgttacgtttttccaagcaaaccttgtttactcaaatgtggaggcaattattaccacttttcttcactcccaacttttttataagatcgtgtattcaaaaagctgttttgggacaactaaaatgttaaatattttatgctatatgatactattatcatttttgtttgtctgttcgttgtgagacggagtttgcactgctgcccaggctgaagtgcaatggcgcgacctcggctcactgcaacctgtgcctcccaggttcaagcaattctcctgccttagcctccccaagtagctggtattaaaagtgtgcaccaccacgccctgataatgtttgtatttttagtagagatggggtttcaccacattggccaggctggtcttgaattccatacctcaggtgatccgccacccgcctcagcctcccacagtgctgggattacaagtgtgagccaccgtgcccggcctatcatttatttttattgtgtgtgttgttacagttcaatgtaatcgtcaattataaaatgcctctcccatttcacatttcataagagtaaagagtttttttaaaagagactttctagaatagagaatgtgacataattttattctcttttgatattggaaaagtaaggatttttagaagatttctaggcaaggcagagaactcagttgtgctttaattggatttacggcatggggactttttctcagcatcaaggtgaaggtgagaacagtataaaattgatgtgggcttagcatttggcatttgcccagagagataagagagtggggggaaaggaacgaagtcctcattcaacagtgattaagtgatggaacatagaccagggctggatgtgaaagaattaaaagagtttggacaactgattgggaaatagtggtgttcctagagaatggaagtgttgacgacactgagtgacagtatgggaacggctgagtcagaaagattgaggggtggggacgaggcatggtaggatgctggaatctgcatttttaaggtgagagtatctccaagtgataagaagattgatgttatggctgtggattgggtgaacaaaacagagtataagggaggtttctgaaaccaacaggtcaaggatccctgaggttgttgggagccatgtgagagcaatgccatttcccacaccacagcagtgttctcaaagccggagctctgaaccagaagcacctgcatcacctgggaacatggtagcaatacaaactcctggatcccacctcagacctattgaatcagaaactctgtggaatgggtcctagcaacagtgttttactgagacctctgcagacctagtggaggtttactgctcatagaccatcatcactcaggacaaagactctttctcccaggtccttagaaaaacagtggacataaatgctttctgttaaatcccattgctgaagtccgttcagagtgaaagaattctgaaacttttcagccatttccagagatgtgccttttgtgtgtaaatgcatttgttttatatttacttgaacttggcattcatttatccactgtgaggtggccttttaaccaaggcccaggtttccaattaaacctgcctccttcaccccaattttttttgagacagtcttgctctgtcacccaggctggagtgcagtagcacgatctcagctcactgcaacctctacctgctgggttcaagcaattctcctgcctcagcctcccaagtagctgggattacaggtgcacaccaccacactcagctaatttttgtatttttattagagtcagagtttcaccgtgttggccaggctggtctgaaattcctgacctcaactgatcccctcctctcggcctcccaaagtgctgggattacaggtgggagccaccatgcccagcccttcaccccacattctgcttgttcattgtgaattaaaggtgtccacatcactttccctacttgctcaaggggaagacaacaattaccctatcacctggcaatccttcccaggagctattcctaagctaccctgatctatctaagaggacaagattcttctaagggtaagtggtcctgatttcctggtcttgacctaaaggggaattctgtaattgtctgatctacctttgggaaataataagtggccccagcttactctgtggaatagaagataacacagcctagtccacatggtggttggtaaacatatagacagacgggaagcagggactcttattgggatccatatcacgactcatgaaatcatcagaggcaccaagcaaatagatggcacacctggaataagaagaacatcaaagggctttggagacaataagggaacttcaaatggtttgctttcctctcttccctctcctcccagcccccatactcacatatggacaaatgtccaagccctattcagcaaagcccattactcttgggtccagctttcaatgaacaaatgcaaacacaggatgggtatatttctccctcattagccatcaggcttgtgcagcttcgtgagaagaaacgactgtcccctgtgatgaccggtagtcatgaggaccttatctctgctcagcgcccttctctccttcaccccaccccaccccacatcgaagccagagcattttcactgaagttcaatctgtttgtgccaagggctctttcttctttttcctcagtagcttcagtatgtttccaccttgagatgtcctcagttatcagagggcgacttagcagtgcccatgctatattcccagtcaaggagaacctgctctgacagaaagctgggccagcagagccacagtagcaccttaaggacagcaggcggcgctcctgccccttataaagttaccctggaggaactgcataggtacactactgaatagcggtgtccagcaaattcttttttttttttttttttttttttttttggttgttgttgttgagacagagtcctgctctgtcgcccaggctggtgtgcagtggcgcgcgatctcggctcactgcaacctcgcctcccaggttcaagcgattctcttgcttcggtctcccgagtagctgggattacaggcacacaccaccatggcaggctaattttttttgtgtttttagtaaagaccgggtttcactatgctgaccaggctggtctcgaacctcaggtgatccgcccacctctgcctcccaaagtgctgggattataggcatgaaccaccaggcccggcctggaaccatttcttggttggacacagacccactctgtcctccctgggatctgtattgggttccctagctgtgtagtgtctcagtggggtgcctggacccgctgcctagctgaagctgcctcttcagacagacagagcctcggtctggggctgagacctgcttagaatctgcatggggtgaatgtggagaacaccggctcccttctcctgaggtctgggcatttgttggcggtgttggtggtcacagcagtatgtgggcccgttgaattattttagtcaagaatggtaaataactcacttgatattctgtctctttgcaaacagtggtctctctatcagtcttggatttcttaaggcgttttaccagagcccacctgataagagtagccttggctcaaacagacatattcttattccaaatacgtgttgtggaatcacaaactgaaactgctatattccaggtgaaataaggagctggcactcacgctggacgcctctgtggggtcttgtggtcagggactgacaggccatttgcaggacacgttggataattgttcaagggacagttggaatctggggaaggaaacagaggggagacaggaggaagagtcacattacacctcaacaagatgtcagcctggccctacagagacaccaggtttaggcagtgaccatgtcctcttggaaaggaagaaaaagacaagctcaaaaggacacaggccccaagagtgagatatgaagatgagcaacagttggagacagcctgggagggaagccgtgaccatcccggtacatactctgaggacctaagagggtattgctgttgctgttcctcctggaaggtcctgataatgaatctatcacagtgtggtgttcctgggctctttgtttgattcattacagctttcttaacaactcattccaatcttcaaaaaaaacaatttttttttttttgagatagggtctcactcttttgcccaggctggagtgtctcactctgttgcccaggctggagtgtctcactctgttgcccaggctggagtgtctcactctgttgcccaggctggtgtgtctcactgttgcccaggctggagggtctcattctgttgtctaggctggtgtgtctcactgttgccgaggctggagtgtctcattctgttgcctaggctggtgtgtctcactgttgcccaggctggagtgtctcattctgttgcctaggctggtgtgtctcactctgttgcccaggctggagtgtctcactctgttgcccaggctggattgcagtggtgcaatctcagctcgctgcagcctcaacattccaggctctagcaatcctcccacctcagcctccctgatagctgggaccatgggtgtgtgccaccatgcccagctaattttttatatgtttttgtatagatggggtttcaccatgttgcccagtgtggtctcaaactcctgcaacccaccattccaaccttagctaaagttgtttcaatagaactgatataacccccaaacttaaaatgtagatgtgtgatccagtttggttgaataaaactccaacaattttggaaacagcatgatggtttttcctgagaaggaatgattttgtgattgcataaacttttagctgacactgattgtctgcccagcacacaggacttctttgagagtggatccagtgaaaatgaggcagaatgaaaagacagagcagtggatggagagatcaggggcatcatttgacctttcatatacatgtgtctgaagccagaattcttccttgaagttcctagaatttggatctttattttattagatcggcctggcccggtggctcacgcctgcaatcccagcactttgggaggctaaggcgggtcagtcacgagttcgggagatcaagaccatcctggccaacatggtgaaacaccgtctctactaaaaatacaaaaattagccaggcgtggtggtgggcgcctgtagtcccagctactcaggaggctgagacaggagaattgcttgaatctgggaggcagagcttgcaatgagctgagatcccaccactgcactccagcctgggtgacagagggagactccgcctcaaaaaaaaaaaaacccggaaatcatgttaccaagtatttatttgggatgaggacaggaaatcgaggacaaggtataagaataacaattccctttaatgctcaaagaaaattatgaactctttttctctagtctgcaagcttagtagcagcagattgggtagcgttcaccaaggatgaagcaggtcccaccaagatgttctccaaaaatgcagtatagtactctgcaatggcagatcaagccctttgttgagcctggggacccagagagagcatcagaaactgagtacggggtcagcagtgggtggtaaagggaatcttggagaagtcacatgttggctgatgagtgatgttggctgtattacagccggtagcacaaacaatctcagtcaataggaataaatacacagagcagtgctggtcacacaggattcgagactcattctcctttgcttcacttttgtgcattcgtgcccatcacacacacacctgaacacattcttaggctcctctccaggttctaaaacctcctatatagacagggtgaaatattttctatatacttaagcttgtttgtctggctccagaaggaactaggtagcatctccttatatcttaaatatagtgaatttcacagtcatatcttggaatcaagtttttggagaaagaaaaatctcttagatttctttggttctctattccatttagatatgagaaaatccaggaccagagatgttaagtatagccacctaagtgacatctgccactgagatccaattccagagcctgtctcctgtccttctgtctagtctgtagctctgcatgctggcatctctcacctggaacctgaagagagcagctgtcatctcctgaaaagtaaaggaccacatcctggtcatctgctggaggctgcttctgggctggcatctcatgagctcttgccgggagcggctctgcccaggcctgaagggccaccaggagaaaggcagagaggagggtgagggtcctcctaactgtagtcacctggaggagaggagggagagcaggagtggatgtgtgggaacggaggagccaggctgaatttatagctctgctgcgagaaggctcagagatggatgctgcagtgagaggaggtaggcatttcgttggagaggttgcaggtgtccattggcctccacatccttctgagactcctctgctctcccagctttcattctagtgtgaatctctaggtttagtgtctatgctagcttggaattcacggtgatgataaggaccctaccattatttctgtttttacctgtttaaatatttacttttaatattgcaaaaagtaatcgaaacagtgatttaattcagtaatttcagggaataaatcctgcttattttctgaaaatgagagctcttctcttcagagatccagaccctcataacagacctgaattccactgtagtagagaactaattcattgcaggattcaagggcattatcaccctcatgaaggggtttttgaggttaggggatgagcagtctcctataggagctggggtagagaggacagcaacctcatcaggctataggtgaaacaagttcagtgagatagagatagagttgattgaaagataaaaatatgtttattattttcagctcaatgtgtgtaaatagacacattgtatgtgtctaatatatactaccttagaatttgagatatgtatacatgtggtcttttttcttataccacatacaaaaatcaactcaatggattgaagacctaaacataagatctgaaaccataaactactagaagaatatatagggataaagctttttgacattaatctgggcaattatttcttggctatgacatcaaagggacaggcaataaaatggaaaatagacaagcggggctgcgttgaacactaaagcacctgcacagcaaaggaaaccaccaactgagtgaaaaggcaacacagaacatgagagaaaatatttgcaaaccctacgtgttagaatgggtaaatatccgaatatacaaggaagtcaaacaattcaatagcaaaaaacaattaatctgattaatcagtgggccagtgagcccccatgatggctcacacaggcaatctcagcgctttcaaaggccaaagtaggaagatcgcttgagcccaggagttggagaccagcttgagcaacacagtgagactccatctctgcaaaataaataaataataaatgaaaactccatgggccaagaacatgaatagacttttctcaaaataaaataatgttttagcagctatgagtatgatcatctctgttggacacgttaagtaggacatgtgtgtttggaaggaaactgcttgagtttattaactgagctcatagccactgcccccagcaaccaacagtcccagatggcaaaatattccctcactggttccctctgaggtggccccataatcacgggtcagattgggaacacagcttcctgggtggaaccgcagtatgaaagtttaagttttgtattgtattactgacagattgttaagctacgtgaggctaccagagtgggcagaggacagtcccctgtcccaggcctcatgttgccacatcagcagctgtgcacaagcaggaaaggacttcccctatttaagggtcttttgggaacaggtgtcctaattttcagggttactttctattgagtagtttaaatacctgctggtaagagcagttgagaaatttgttgggaagctggcattaaaataggagttcacagagggataccttgtctatggtcagccctggccaggcccaggtagctaccaactatgaattctccatgactcctaagacaattgaccctgtgatgcctacactggtgctgaggctgaactatctggaccaaaagaatattgaaagccactgggacagcctggctgtgtatcatagtatccaccctgtaaggaggctaggctaagaatgccactcacacacagatgaggatttggaatatggcctgaaccagcctcctgggaacctggggtccaactataaaaacaaatcaaagctgtttggacaaacaggtgtgttggagaatgcccgggtgagaggagtaccacctcggcttgtgttgctaagcagggcaggtttgttggactttccggaattaaggatgtacatgcaacatgtggtttcttagagggagcaaccacctcttctcttgaccttagagagttcagactgaacaattttttaggaccgtttgggcctagaaatcctgagatttttaggtgagacctaatgtgtctcagaggtctcacaagggagggggccaaggtggcagcaagacggtgctgtgtgctcaaacaccttgttctaaagccagttcagggcaggcttaatggccaccatacactcagcatgagtgggatgattactctatgcttgggatacacaggaatgagctggtatggtccctcctgggttatttgagggggagtcctagggagaatagtgcacattttaaaatgtaccactctccaccctcctcctcctcctcctcatagtgaggtaaatggcatcagttttctggaaatgggaaaagaatgcagtcactcctgagggaataaatacctacagcgaggttgccaagcccagtgtgcaggccgggcagccactgttgccatgggagggttgtgcacagcgctggtccagcaggccggatacacaggacctcccctgcagctctgtgtgaaggcagcaggcaccgcgctgtggaggacttggggcagtggagtgagagctgaagcgtctccctcagtcttaaggaggcaagaggcatctcaagcctcgctaggggtggtcgctgttgcagagcagtgaagtcggctgcccctatgaggaagcagtgagttcctgatctgtagcagcccagcaatttcaccgttggaggaagtgggcactggactcattccagcagaggaagagattagggccattcagggaactgggccccagatgatggttttaggttctagggcattagtaggtgcctgaagggcccagtggatatggatgtagaggcaaaatgagaaggggtgtgtgtgcacgtggggaaagtctgctggttttgggaaacgtccagtgtcctgcagaagtgaaacctggaccagcctcctgcacacagaacacactccaatccacaggcatttcctcagtaacacatgagcgtgctgttatggggagagctggttaaatttgggtgtgatgttgttacgcacaggtctcccaagtccatagtttttgcataacttgtaaggcagcctcatggtgtgacctaggccctatggtttccttgcactagagggtatagctaatggggttacatgaagacaaatggtgttcccagcaaaataccgctctatgaagtcacctgcagggtacgcaacaaagcatgagctaagagagcagctaagcaggggtccaggtactggatgtgagccagcaccatgtcctggcggtggtgaggtccctaccctgtagcagtaaggagaggctggtttagtggtgacctcaccatcaaggtgagattccttggagtcccctggttctggtgaggctcttgttttccttgacaacccttgggttggggcgctgtggtctgaggctgttgccatccatgacccctaccccagtcgatttttccatgaatttctacaagtgtagacttccagtgtagacgtggttgaaactgttctctcatacacatgcatttgaatttccagagaatattgaagtgagcctgcgctaggttggagctgaccataagagccttgacaccatcaggctggagtatatattctgcggaagctgtgggtggggctgcaggtgtgggtgtgacaggagagagggctcccggagcagcaaggatattcccacacagctgaggctgtctggtggccccagcagacacagggtgtgtggaccttgggcatggccctggaacatcgttttgacctggtagggaagggcagtcttggaacctagcgtgcgtgttagcgtggggcagggcggaggctgcgtgggggtgagctctgaggactgtccacctcccagctcctcagagagcaccaccctgtccctcccctcagccctttgtccacccgcctgtggggagggtcctggtgctgcctgtgccacacagcgactcccacgcctgcagatccagctgggacaggcaggagttccaagtccctggcttttgtctgcctttcccagccacctctcacaagctgtctatctgtctagtattggcgtctgcagaaattttacaaaaaactatgagggaataactccgttgagctgtttaaaatgcgtccctaaatcattgactctcctcacacagaaaaggaggtttacttatcccctattgaatcgagacctggtaacatcttgacaaattgagtgcacctgacttagtgccatgctgtttttctgggatcgggcctgatgaactggtatctttcacttcctctctattggatggtgctgcaacctgaatatttttgtccctctgaaattcatacgttaaaatcttaaaccattagttgatagtataagaggtgggagcttttgggagttaagaaggtcagaagggcacaggctttatgactagcattagtgcccttatagaagatgccccagagagctccctctctggtgagagggctcactagatgagaatacagtgagaagatgccatctatgagtcagaaaagcagctctcatgacaccaaatctcctggcaccttgatttagacttatcagtccatgagaaacacatttctgtttttataagcagcttggtttatggcattattttgctagcagcccagacagactaagagcgctggtgactttggagcccaggcaccatgcttagaggaagcctaagtgttggacagggagaggaaccgagcccatctacaaggactggctagagaatgcaaagcaacccgctttctggggaaaaaaaaaaaaaaaaaaaaacaaaaaacaagaaacaaaaaacaactctgatttgcagtgtttttaagtttctattcttaaaattctcctagctatagatcatttaacaattatttcacaaaaactcctctctcatgagccagcatgatccgaccccagcatatcacacagtcccgtccctcagtcttgccggagctcccacctgagccagcactgcctgcccctgtgcaggagtgtctcagccctgagatcttcagatcccagcagaacctctcctctgatgcccctggagggagccaggccccagttgcaaatgtgtgagtgaagacctgatggtgctgtttcaatcctctgaattttgtggtggctttttacaaagcagcaggtgaacagggagagaagttctcattgtcatggagagaagttggacttgtgcactttttgtatgtaaacttttgcttctctaaaatatcgatggatcttctcactttattttcaaagtgtaacacagagcccattgtggtgggggaatgggattgtggactttttccagtgactgactaatcccctgtcaactgttcttagtttcaattcttccttggggagtggggcgatatgggacccaggtgtggtgccaacctccgccctcagtgacagattcagaggtggccttgggacttgggtgtaggctggaacaatgggaaggaagtagggattttctccaggagatcagctatgaaggtcacagagagacgaccatgattcacatggctgtcacctggggagagagcccaaagtaagatcaagagaaataaatgggaaaaaggtgaagacaacaatgtaacttatgctttgagtccttaaatcaagtatttcctgaagccagaattccccctcaattccaagatataggagtcaaaatgttaactcagcttgtcatggtttgacttttgaattcaagaccctactaagttgtctgaaaaacatcaaaaataccaaactcagagaacctgaggcaaagatggtgcagtgcacaaggacaggagatgagagcagatgacaggtgtactgggggcagtctgggcatcaggctccctggtgattcccatgcacagcccgggggagaacagccttgttgatgctgatcagcagggaaggagggacaggtacatgagaggctggaaggacagcgggtgagtcagggatggggagcttcatagttgatgttcagagctggaggaattccaggtggtggcaggagttactgggtggccatgtggtggagagctgggacaaagaggacggggagtcactgtcatccaggaggacagagcactgaaaggttgggagggtgatctgccaggaaatattagtgtgaactctttcccttagttttttttttaatgagttatttagcttttagtggcaaaggaagaaatacagaacttcaaaaaaggaaacgagcacttttctcatctcttacattctggttttgtttgtaagcagagctcagaacaaacagtgatacagaacaaaacaactctgtacttttcttgtaaaagaaaaatttcaccaagactttcaagaaatgtcaaggaaacgtttattgaagactgttgcaataggagtcacaacgttgtaataggaagagccgttggactcaacttacctcaagccaaaggcaggagaatttaagccttgaggggagctagcaggctagctctggaggtcgttaggagggaagttggctagtgtgattgggccatctgtgtttgctaatttgtgcttgttggaataagtctcctatcctctcacagagacagggctgctgccctcttgtgtaattacatttatatggatgaggcatctgacttattcaatatttattgttccaccacacgagtggttcctggtagaaaatctcttgtatgtcatcagtgaatgtagagtgtttgtgcatccagtgaacagttctgggtcttacttgaggccgagcaagttgtcctggttgtttggagaccctcaaacctctccctgaattctctgtctctagagtttgcagtagtcatagcccaccgtagactgcagtagcagaagccacatgtggtgctcccagtgtgtctttatccacacagaggagcagggaggctccgtcctcatctgcccctttcccttgagttgatggatgcttctcagcacatcagcctgaattctactgcatccttctatctggcaacatccattcctcaattcagtggaggtcgacctgaccctgcatatttcttgccctgatatttttctctccaccgaacattctactgtaccccttcttttaatctacccatgttttaaatacctctgtgtttcaccatgaaatcttttcttgcactcaaaaccaaaatagtctgcttctttcttctaaactcctattgcttcatgaagccacattttcccaaggatatttttctatatatcagccttcaatgtttttaattggcttttttttccatgctgccacagaaacttgatatatagactgctttgtggctgtagttttcattttttcctatgcagtttagtaataataataatctaattttatatcactatgtgatattagatatgattaattaattttatcacaattaatttgatgatctcttactatgtactaggcagtcatctggaccctgtggtacaataatgagcaaaacatgcaacttcccttctagagtacggagggaaatgttacagagagtgagtgaagtgtacagaatgtgagaccgctacaattctacagttagaaataaagagaacaggtgggatggagattgcccaggaaagttgctgcagtttaaaattgagaaatcaggaaagacctcagtgacaaagtgaaattttttagcggagaccccaggtctgggaaatgagccaggtgtacttctgggtgaaatgcagatgcccctgggtggagtcagcctggcccagccgacagtttggaaaaatacggaatgttagttcagggacctcaggactttgaagcagtggcagttactagaagccaaggaagcctcctggccttcacaatccaaagttctgtgtgtgtccttcaccgtctaaacaaggggaaggttgggatcatttgtctgtcagaatgcctttgtcctccctgggatctgtgttgggtttcctggccgtgcagtgtttcagtgtggtgcccggactcctgaactgcctcttcagacaggcagagcctcagtctggggctgagacctcctcagaatctcatggggtggacatgggaaacaccagctcccttctcctgagctctgggtgtttgtgattggtgttggtggtcacagcagtgtctggcccttgagatgttttggtcaagaatggggaaaacccacttgaaatgctgtatctttctttgaagtctgtaatctctctgtcccactcaaactccttgtgtcattttatcagtgaccacctaagagtaactgtggcttcaatataggttttggtatattgtgtttctaatttcatttgtttcaagcaatctttaaatttccttatttttttattgacccattggtcattcaggaacatgttgtttaattccatgtgtctgtacagtttccaaagttcctcttatcattgatttcaaattgtattccactgtggtcagaataatacttgatataattttgacatacatgatataggtttgacttaaaaatttgttgagagttgttttgtggactaacatatgatctgtcctggagaatgttctatgtgctgatgagaagaatatattctgcatcagttagatgaaatattctgtaaatgtcagttaggtccatttgggctagagtgtagtttaactctgatgtttggttttgttaattttctgtttaaatggtcagttctttattgaaagtgagttgttgaagttttctactattattgtatttcagcttatctctttagatccagtaatatttgcatttgaatgctctttgaatttttatatccttttgctaaattgaccactgtatcattacataatgaccctgtttgcctctttttgtaatttttgactcaaattctgttttgtctgatagaaatatggctactgttgctctcttttggtttccatttgcatggaatatcttttttcatcccatcactttcaatctatatgggtctttatagacaaagtaattttcttgtagggagcatatagttggatcttgattttcaatccattcagccaatgtatgtctataaactgaagaatttagtttatacttaatgttattattgataggtaagaacttactattaccattttgttacttgttttctgtttcttttgtaactcatctcttccttttctttcttcttttattactttcctccttagtggttaaatgattttctctgatagcgctttaattctttgcttttaaaaaagtgtatgcatggctgggcacggtggctcacgtctgtaatcccagcactttaggaggccgaggcaggcggatcacgaggtcaggagatcgagaccatcctggctaacacggcgataccccatctctactaaaaatacaaaaaattagccaggggtggtggcgggcacctgtagtcccaactacttgggaggctgaagcaggagaatggcctgaacctgggaggcggagcttgcagtgagctgagatcgtgctactgcactccagcctgggtgacagagtgagactctgtctcaaaaaaaaaaaaaaaaaaatgtgtatgcattacaggtttttgctttagggttattaggaagattatgaaatgttcataagaagttattttcaacaaatgacaacttaactttgatcacaaagaaagtagaagaagctaacaatgacagaaaaacctaaaaaactctatactttaactccctcccccccaacatttagacttttttgatctcagtgtacatctttttatattgcctatctcttaacaaattgttttatttattatttttcatagatttgcctttaagtattcatactagagatatgagagatctacaaaccacaattataatattagagtattctaaaattgtctgtgtacttacttttaccaattggttttataccttcagatgttttctttttgcatgttggcatccttttcttaaagactaaagactttccttttataattttgtattaagacagacaggtctggtaatgaatttcctcagtttttgtttgtcagtcacaacctttatttctactcaatatgtgaaagatagctttgctgggtgcagtattcttggtgggaagattatctctcagcctgtgccccagcactttgagcatatcatccctctccttgttggtctgtaggatttccactgagaagtttgtagccagatgatttggagcctctttatgtttaatttgcttctttctttttgctgcttttagaatcctctctttttcctttgagagtttaatgaccgtatgccttatgatagtcttttttgtgttgaatctgtttgataatgtttaaccttcctatacctagatatttatatctttctctatatttggaaagttttctattattatttatttaagctttgtagcccttgccctctctcagctcccttttgaaggtcaatgacttttagatttgttcttttgaggtattttctatatttaataggtattcttcattctttctgttattgagagtctgacagctttctgctaggcagtttatttctcagttccagggtttctatttgctttttagaaaacgattttgatatacttgctaaatttttctgatacatttctgaattacttttctgtgtcattgcaaagcttgctgaatctcctaaaaactgctgttttgaattattgaacattgccatcttcttagggttggtcactggctcctttgtccattggggctggtcatctttttctgtttgctgttgtttcttatgcaacatcaggtataccgaagactaaaggatgggctgccatgtaccaggcctccatttcttaatctctcaaatctagataattgtctcctacctcatgtgtggtagggaaagcaattggtgtgatgcctaacacaatggggacaatgaatggatattaaccaatattgccatatttccttgatcctaagatggtagctgtcttatattatttttttctttccataactgaatacctaagactgggtaacttacaaagaaaatacatttttttcttacaactctgaaggctgggaaatctgagatttagaggctgcatctggtgagggccttcttgctgataaggaatctctgcagtcctcagttgtgcagggtatcacatggtgaggcgggacacactgagaggaactggcttttacaacagactcacagcagactcactcttgtgacaatctactaacacgttaattcatgaatgggttaatccattcgggggcatagagccctcagaaccccatcatctcttaaagaccccaccttttaatagtgttatattgaggagtaagtctcaacatgaacttttggaggacatactcaaattatagtaataccaattacataattatagaagtttatcaaagtaaatcaaagcaaaaccactatcagattacatttacacataggtgtaagatgcatcaaaagtttcaaaagcaaggctgggtgtagtggctcaaacctgtaatcccagccctttgggaggccaaggcgggtggatcacctgagattgggagttcgataccagcctgggcaacatggtgaaaccctgttactactaaaagtagaaaaaattatctggatgtggttgcatatgcctgtattcccagctacttgggaggccaaggcatgagaatcgcttgaacctgagaggctgaggtggcagctgcctgagatcacaccactgtactccaccctgggtagcagagtgagactctgtcaaaaaaaaaaaaaaaagaaaagaaaagaaaagaaaaaaaaacccaacaacagtttcaagaatttaatctgtgaaaaacgtgatatagaatatgatagaactaggatattattaaagtccttctaaagaactggaacaagattgaaatacagagaagacttagaagattgctcagtaaaactgaaggtctaatgtgatggttaattttatgtgtcaacttggctgttttgcagtggaccagatatttggtcaaacattattctgggtatttatgtaagggtgtcttattggatgtgattaacatttaagttggtggactttcagtgaattaaattgtcttgcataatgtaggtggtcctcatccaaccagctgaaggcttgaatagggaaaaggttgaccttccctgggcaagaaagaattctgccagcagacaggctccagagttgaactgcaactttgactcttccctgggtctccaggttgatggcccatcctgaagattgttgacttgctagctccttagtcacatgaggcatttacttaaaacaaatctctctatacatacacattcttttggttctgtttctctggagatccttgatcaagacatacagtttatgtagacacttcatttgtgtggtcacctgaattttgtgcagcagagaacaggaagatctgcagttagactgattggggttgggacatgagaatgaggatgtgtgggatggaaagatgaggagatatatgaaggacatggttaaaatgagagtgaagtgccttttatcacacctttttgtttaggtccatgctgagccaagaatttccatgaacagaaaaagcttcccgttgcctgaaggaagggtgaagaacatcttctgtctatcttggtttttgcataacttgctgtcctcctgaccagagacttgatgctcactttaatagctttgggcccgaggaaacatttattttgtttcttactgtaagttttactcaggatagtagagagtagggtattctcccccatgaccttggagtcctactccatggaagttattcatattgcttgatcactgtgctaatataagacaagagtcttagcttcaagggaaaactggacattgaagagatctgcctggaaaacctagggttgtttatactgtagcttctcagaatggagcagcagagcctctaacaaactcccacgctgtaactgatgtttacataaagactgatgaagaacaggagatgctattcaagattcttataaaaacagaacccattggcccagcacggtggctcatgcctgtaatcccagcactttgggaggccaaggtggggagatcattcaaggttaggagttcgagaccagcctggccaacatggtgcaactacatctctaataaaaatacaaaaattagctgggtgcagtggcacttgccagtaatcctagctacttgggagggtgaggcagaagaatcacttgaacctgggaggcggaggttgcggtgagccaagatcgtgctactgcactccagactgggtgacagaggaagactccatctcaaacaaaacaaaacaaaacacccaaaaaacaaaaagcagaacacatcaaaaagaaagggcagagaccaaccgactaatcaattttggctgtgagtaaagcagttaaatagaggagcatcacagtgacttttaggcaaccaggtgggacctggaaaatccttccctttcaccctacacaccaacctgacctaagttcacagactttgtagagtgaccttaacttcccaaaagatgtacttgtatagagcatctgaggtctccccactccccattctggttcctgctgtcggagaccctcacctcttgggtggtgcatgagaatgctcgccttcctctatcatgctctcttgctggccctccacttccaggaccaggtgtgacagcaaaagtggaagagagtcctgctaagaaaggttgctgaggcagagaaccagcccctaccacctatctcccagtaaagtggagagctctcaccaaggaccatcagatgaggaaaggcagcaccagcctgcactagcctggtaggttctttaatattggaaggactttggggcacagagaaaaatctcaccactatttacactaagtttaaaccagttcttgagtattaaatattgatacaaaggtgattatttaaattcccttcatctatattgatgtaatacatttagtatgcctaattgtttttaaacacatctaataccttaaagaatagataaacatattcctgaaagacaatcacaaacttattcattcattataccaaaaatgatacagaagggcccatatcatggatttgacatcttttctcatttgttttgagtttactccttcctatgatttttgtgatcttccgagaccccaaatgactaaacgaggttgcaagtctagggccaaatagctgacccttgatcaggaaacagtgctttgcatgtgtctaagatgaatcaaacccagactacttgttatttattatcaggctgagactttttgttgttgttgtaataaaaatgtttggttttttttgtcatgtcatgacactgttcaatccctgtcttttatataaattttaattctagaaacttgtttttctcacaaatacgtcgttcttaagtttttgcatagccctaagtgtatggccaattttcttatcattatgatgtattgacttggttcattggcataattaaaaacatattaacatatattttctcactagcattttattaaaatgagtatagctttattataataaatagagttcatatgcttgaagggatggagagttgagaccaactccttcattaaacattggtctaattaaccttttggggaccagtgagggaccatttgtctcattggttattgggcctcgtcctctatggtcaccagcttctgagctcctcttctatctggttattaattgagatcactgatgcttgtcagtctttcttgttttgggcacagttttaactttttccttagtaaactttattttattctatcttgttgatacagttatatatcaccaaaacagagtgaaataaagcttaatgtaaagtgtatatatttaacacatctgcttaaaatttcaaaaattatgtatagcaatgctttcccactttttaaaattaaaggacaagtaaacatagcccattagatctatctttcctttgagccaacaaccactttttgcctctcattgtaaacttctactttttgagtatcattaggaatgcattgaatttttaagtttcaaactattccaattaacacttatatcctgtcaggaatggtggctcaagcatgtaatcctagcactttggggggctgaggagagcagatcacttaagctcaggggttcgagaccaacctgggcaatatggtgaaaccctgtctctacaaaaaaatacaaaccattagtagggtgtggtggcacatgcctgtagtcccagctactcaagaggctgaggtgggaggatcatttgagcacaggaggtcaaggctgcagtgagccgagattgcaccgctgtactccagcttgggtggctaagttagacactgtctcaaacaacaacaataaaaaacccaattatattcatttttgttattttgttattgctctatgatgctcaaattgtgcatcattggaatgcaaagaccagttaacttaatgtagatcagaattctcaatacaaaggaaccatacaaaccaccatataacaaagcaaaagaaaaaaaaggaaaaagaaaagaaaattaaaaaggtcaaacacactaagtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatg

SEQ ID NO: 708 - DNA, 476826 bp, Homo sapiens
acggcctttatctctgtagcactttctagttgatattgtgcttttccatatattccgtatattcatgtaatccctacatacactttctaggtagatcactggagcggtcagtccagtggggaggctaggagtgcagacctggagccacgctccctgggtttgtgtccagctctgccacttcccagctgggtgacctcgggcgtgtggctgactccctcttgtgcttcaacagcacctacttcagaagggtgttgcaaggattgaataagttaattcatgtaaagttctaagaactggcacataaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccatttaaaagagaaaaatataaggcacaagtttcagccctctctacgtgattaaataactaatatatattggtgttgaaaccaagtgttttctgagataataatataaaatgttaacatccttctcttccccattacaggggctcatttctgttgctctgacgaaggtttctgaaaatgaaggctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaacacatcagatcatttcaatgcctcatttcagccctttgattcgaggaatagttacattctttggacctcagattttctgcctagaaaatataagttattaataataattttagctttcctttcagatttagttttcaagaattgtactgttataaaatgaatattatctaataccttttttgtgtttttgagacacagtcttgctctgtcgcccaggctggagtgcagtggtgtgattttggctcactgcaacctccgcctcccaggttcaagtgattcttgtgcctcagcctcccaagaagctgggattacgggcacaccccaccacgcccggctaattttgtatttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaactgcctttcacaaacagatctttgtatggattctaagaagactaggagtaactgggtgcagtggcgtgtgcctataggcccaggcactcgagaggctaaggtgggaggatcccatgagcttaggagttcgaggctgcagtgagctatgattgcacaactgcattccagcctgggtgacagagcaagactctgtctctaaagaaagaaagcaaaacaaaattagggatagagttttaaaagtgctaagcaatacaccatataatccatgaccctattaataatgaagcttctggcataattccagcttttaaagtctttatcacacctcttggtaagctttgaaattaagtggggaaacttaccagttacatatttgtgtaatctatcagttttcactagaatgtagtaagccagcatttttcttttagtaataggtttctgttgagcattcattttaaaattgttcttcaagctacatgcatttccaaattcaaagtggatggaaatgcttggccaggcgtggtggcttacgcctgtaattcctgcactttggccaaggtgggtggatcacttgaggtcagaagttcgagaccagcctggccaacatggtgaaactgcttctttaccaaaaaatacaaaaagtcaggcatggtggcaggcacctgtaatcccagctactctggaggctaaggcagagaattgcttgaacctgggaggtggaggttgcagtgagctgagatcacggcgctgcactccagcctgggtgacagagcaagactctctcaaaaacaaaaaaaacaaaaacaaaaacaaactaacaaaaaacaaagttaatggaaatgctagatgtttgcattatgccataaaatgcctcggacttcataaatgccttatctaattgtgtttgtcaaaagactgtaataggcaaaatacgccatcacctgctggctgttctttccagaattccatccaaagtgctagatgtgaggacagctgtcttgcccactgtcaggaggagcttgtggcttcccacagtgtccattaccatttgcggttcggtggaatcctactctgactactggaaatttttctgtagaaatcagttctttttctgattttccacctttcatggtcagctgttcttgtattttatcgtatatgtagtcacacctatacttccataaacgagagtttctattctgatatttggtcacagtctgagtgtcatttggctacaaactggtgcctccctctccctacatcctatgcggctctgtccaggtcacagctggttgagcagaggtacagcccggcagtgtgacaaccccaggtgatgctttcctgtcaaaggacactaagaggacactggccactaacactgtcacagcagggaggtgcagcgtgaatggagagcaaagactggagacgtcttaaagggcggggtgcgtcaccgaggaggcactgagcgggatggctgtccttgtgaccacgccacctggattctgttcattggcgttgtccgggggagaaacaaaccgtctgtctttgtaataggaggcagcgatgcaagttgtaggaagacgcccactgaattgtggcttgcacaggcaggagggccctggcgtgaggggtggccagggagagcccagtgagggacgcagctctggggccccgcgcccctggaggttgccccggaggcagggcctcgaccttgacccacagggctgggtggggctgaaaatgggctcccagaccagcgcgaggagctgcgcccaggcctagcaggcggtttggccgcggctgcagcttagcgtctaggccacgccaggcaggctcccggagccgtccactgccccaccaggaacgttccgggctcttctgctgcgcgcggaagcaagtgaaatccagcctcaaagactctgatggaagaacacctgtgaataccgcgccctctaggcgtccgccacaccccacggccccccagacggggtcttcttttgttgcccaggctggagtgcaatggcgcagttatggctcaatgcagcctcgacctccctggctcaagccattctctcgccttagcctcccaggctacaggcgcgccaacacgcctaatttttttaaactttttttttttttttggtctagcgacggggctcactctattgcctagggtggtctcaaactcctggactcaagcgatcctctggcctcggcctctcaaagttctgggatttcaggcatgagccaccgcaccggtccttgagacttttgacctccgtgcccgcccctccggaatgcccaccccagccaaactcctctctctcctccagctggtggctggggcacggccctctccaacacctctgcccctccgctattgaacttcacatccaagtttatgtcacttctctgtgcccaggccatcggatggccccagctgacagtggcatcccgtccctacagtttggggcttcacccatattcacaaaggaccaggggggtaaggacccccaaccaggcacccacgttggtgaaggctccccacttcctccatcagaatccaccgctggggaaccctggccattcgcgggagctcccaatattccccagtaggcgccccgcccaaactacatcccttctctccactagacctgggctactctctgggagaatgaaatggcctctgccagacagggactcacccaggacacaacccctcatcccgttgaacagactgcgtatgtcctctaggctcaaggaaacctgacttgctgggcctggggcccttaggcctgctcttattcagtattcataagaatcagcaaagcgtttcatagagtccacagattcatgcaaaaagaggagaaaagcacaaacacagcagcacacatgcacaagcacacacacacatgcacacacacatgcacacacatacatgaatacacacaagcacaatgcacaaacatacacgtgcaaacacagacaagcacacacaccacacacacaagcatacacatatgcatacatgcacaagcacacacatacatacgcacccaagcacacatgcaaacatgcacacatgcaaatacaagcaaacatgcacaagcatacagatataagcacacacaagcacacacacacaagcacatatacacccaagcacacatacaccaagcacacacacaaacacacgcacaagcacacatgcacaagtgtgtagaaacacacacaaggacatacgcacaagcatgcacatgcataagcacacacaagcacacatgcacaagtgcacacgcacaagtgcacacaagcacacgcataaacatgcacgagtacatacgcacaaatgcacacgtgcaaggacacagacacgagcatacacatacgcacacacacacacaagcccgcatgcacagagaccttcaaggggctcccccccggcccaagaggaagtcattccgacttcctgcctaggtcctgcagccagagcagcagcaaatgccccaggagacggtcctttcaacttcctgcgcccctcggctctctgacaggcccaggccaggccttattatccctcagtgtggagcccagtgcaagcgccatcacctgctggagggagccgggactccgcacccgggcctgcccgtagaagcctcgtgcgctcgtggctttagtgtgcccttttcctccatgcctgcagtaagagctgaggcttgaccaaacattccgtttgtttcgagcattggtaaagagcaggccaaagggcccgaggccccacgttggcggctgccttgggactagcaggcacgctttgcaggatgggtccagtaggtatagagatcgtttgcgttcttggtccatctctgtcattcccctagagagcagggtaggcctagcccccatctctgtcattcccctagagagcagggcaggcctagcccaaggaaggtctattcggccacaggtttgggccacagcccctggtttggcgaaaaggggggtgcatgcggctggcctgggcagaggacataggcaacctttgccgatgggttcctgggccccgggtcctgtccacccgtggtcatatgtggacatgggtgaagctccaaactgtagggatgggatgtaactgccaacaggggtgagaaggtcctgggcggggaccgtgacagaggctcctgtgtgagatgtttgacagtggaggggcaggaagtgatggagggggccgtgttcaggccatctgtaagaggagagagagaggcagctggcagtgggtgtgcagtaggggtggccacagagagcctagaggccccctattcccagacagactcccatccaaatccttggagaaccccattagtacagccgggaggggaaacggtatggaggttcttcaaaaaattaaaaatagaactgtgatatgatccagctgtgctaagtatttatctaaaggatatggattttgcatattgaagagatatctgcattccagtgttcattacagcattgttcataagagccaaccttatgaagtcaacctaagtgttcatgaatgaatgaatgaatccagaaaatgtggtatatattgacaatggaatactagtcagcctttaaaaatagaaaagggaatcctgtcatttgtgacaacatggataaacctggagggcattaactgaaataaactaggtacagaaagacaaatcccacatgatctcacttatgtagaatccaaaaaaggaattcacagaagcagagagtagaatggagattgtcaggggcagacgagttgattgaggagatgtgggtcaaaggatacaaaagtccagttagacaggaggtataaattgaagagctgcatagtgcaacatggtgactagagttaacaacaatgtgtttacgtctgtgaacctgcagagagaagtcacttgagaactgctgagacagtagattttaagtgttctccccacaacaataaaagtttgttaagtgaggattatgtgaattagctggacttaggcattctacaatatatacatatatcaaaacatcacgttgcgcacatacatatatacaatttttatttgtcaattaataaaactttgataacagaacaccattatgatattgactattgaagcttatactttgaaaattttctaatagcaacattgtgtatttacttcatactttatattactgtattcagtttactgggttcttatgaaataaaataatgcagcaaaaacaaaacacatcatcttctttgtacatttctggcaagacatctgcatagtaagtaatttggctttgcccaaagagaggtctggccccttctgttgacttcagggaggtaacccatatcacacctgacagagtgtccttgtgtagagccgggctgaccacactggatctaatggagaggctgcccacacctaacagtctcagggtatggggtgattatgccagaaagaccaatcatgtaacctagggtagtggctttggtcccctgatatgagtttgtttacctgatgactgacttgacccatgtgagaaatcatcagtcagtcagtcatgtctacataggaaagccccggtcagatctctggacagcagagtgtgggtgggcttccctagctaaaaatactcctagtgtgttgttgtgtatccatgcaggtaggctaacacatccggaggacagtggaagctttgcatttataaatctcccagactcagctctgtgggtctcctcctttggctgatatgagtttgtacccttgccctgtaatacactataaccatgagtataatagcttccactgagctctgtgagtccttctgtgaattactgtatctgacagtggttttgtgaacaccccaagcttgcaaaggcagtcttaaggaatgtgccatgagactttgcagtttggctacttctggggagtactcaacagccaatctcctagcatactattattctataatatgcatcaggattaatcaatatgcacttgggcttagctgtaaatttatgaaaaataattaaaatatgtatctggtaaaataaataccagtagctgtatgcattcggccctaactaaatgctaggtactagacaagtattatttgcttggtttatcacaccaacctgtgagatacatagttatgcctaattctaaggaagaagagaaataaaaaatttaaaaaaaacccagttgattagaatgctactcacacactgtgttgggagaatgttattttaacagtatagacatggtgactataacatgtttaaaagctgtttcttagaatgctttctatacactatgttgcaaatagttttatttcagagactggatatggtggtaacacaataatgcctatagtgtaaagacatatttaaagatgtttctgagaaagctatgtacacactatgttgagatcagtgtcatttccaagaatggatgtggtgagcactctgtatgtagcgttaaaagacacatgtttacagatatttctaagaatgctacacgtacactatgttgtcgtagtcttattacacagaacggatatgaaaacccccaagtaatgcatgaggtggatgcagagacacacatttcacagctgtttgtcatcatgtttctcatacaccatgtggagaacagtgttacttcaggtggaggtgaagcccacactctaatgcatgcagagttgggctaaaagacacttgtttaaaagatatttcttacaaggctacttgtacactatgtcgcatacagtgttgtttcaaagaatggatgtgatgaccataaaataatgcctatagcaaagtactaagacacgtgttttaaagctgctttgtggtattctacatacatactatgttaagaacaatgttttggcagtgagtgatgtgatgactgcaccgtaatgcacttaaggaatgcttaaagagaggtattacaggccaggtgtggtggctcatgcctgtaatcccagcactttgggaggttgaggtgggcggatcacctaaggtcaggagtttgagactagcctgaccaacgtggcgaaatcccatctttactaaaaatacaaaaattagctgagtgtggtggtgcatgcctgtaatcccagttatttgggaggctgaggcagaagaatggcttgaatctgggaggcagaggttgcagtgagccgagattgtgccattgcactccagcctgggagacaagagcgaaactccgtctcaaaaaaaaaaaaagacataggtattacagatgtctcttgaatgttactcttacactatgctgacagcagtgttatttcagaaaatgtctgtggtgaccacactccctgaaactaaaacgactagatgaacacactggggaaaatctctatgacattggtctgggtgatagtgttttggatgtgacccccaaaagtacggacaacaaaagaaaaattaagacaaatgggattacatcaaagcaaaaagcttctgcccagcaaaggaaatagagtgatgagataacctaaggaataggagagagtctttgcaaatcaaactcctgaaaaggagctaatatcccatggcttctaccggcatccatgaaaatggcaggttaatatgacgacttacaataggatggaattgaagaagctgcacacttatggaaagttttggtaatgaggctgggatgctgagagatgactttctggcccctttgtaggcctggtaagaggacctgtgaattctcttggccaagtggtgagcaaggtggggatgagtgtcctgcactgtcctgtctgcgaatgtagcgacgagtgggtgagacaggattgaaacaagcagcctgagtactttgcttgttcatgtttctcctgctaggaaaaaggggtaaggggtccccagagctgacactgagccttgaatgaatccaaagcactagaagttgatatggttgatctgtgagtggcaagaggctgctagaaactaaaggaaaatgtgctttgttagtggctttcttaccagcatggaggtgcccattccctctgcactccgtaatcacccatccaccagtatccaacttcagcatcttgaaagattaagccaagtatgaatgggtatttgagagaggagagtaactctttggagataggtgttcagttaaccatcctgtgtagtcccctggagcacacggggagctctgggtgcagggtaggtggaagccccagaggactgtagggtctagagtggtggcaaatgggcagaaaggagtaaattccggatcctgggtgctctccaaatgctgggatgcccacaggggagaaggtagcacaacccttagagaaaaatcccatcacccaaaccctctcctcaccctagccccttctggccccttgtgcctccacacccttgcacaggggatggtgcaatcttaagtcagcccctgactcagacaggtgtgaatcaccatggtctgtgcttactgagctaatgctaagcgtgcttcatggctctctatagtaaatcaaaaatttgtttgggtgacatatgaccaatgagagttctgtaaatatgggtattaatgaacactatgtgacaatgaagccttttgtattatagaagcacatattcaatgaattctaagcacaatcccaatagtacttatctcattcttaggtcatctttgcaaaggaggcaaagccaagccaggtcctgctgctttgactgatggtgggaagaggcggagtgcatgggtcaccaggcagtggggaagagaggaaaccagcgtggattgcacttcactcacccagctctgtcctcctcctctgattgacatgctacaaagctcagtagggtgtggtttcatagcctgggactcaagaatccgggaattatatgaggacccagcccaggtgcgtctttgggaggcacacgtgagtatctggagtatacagaagacagatgcactgtttactcagggcatggtgtgccaagccgtgtgctaacagcaggttataggctctgggtgacttattctttgggctaactcaacaatggaggaactcattatccttattttacatgaggaaactgccgtttagatggaataaataaatagacaggattaaatggctggtaaatggtaaactgatatctcaaagacaggtcatctgatcgtactttaggtgagctaggcagcctcatgccagctctctacgaaaatgccacaagcagcagagggtgtcatttgagcctttgatgaacaggagaaaacctcaaacgttgccactcatgagaatggggttaagattgttacaacatttgacgggacacctatttgtaacttttttttttacttcactgggaaggagggagacacccatttttatcttaatgcagtccatgaaagtgcctgtaaggcttatatgggttcaggccgggcacggtggctcacgcctgtaatcccagcactttgggaggccgaggtgggtggatcacctgaggtcaggagtttgagaccagcctggccaacatggtgaaaccctgtctctactaaaaatataaaaattagccagatgtggtggtgggtgcctgtaatcccagctactcaggaggctgaggcaggagaatcgtttgaacctgggggggtggaggttgcagtgagaggagatcgtaccacttcactccagcctgggggaaagattgaaacaccatctcaaaaaaaaaaaaaaaaaaaagacttacatgggttttgagtctatctcttggataagactttacgtggaatatattttatctcaaaaagcatttattcagccactgataactctatgaagctctgtaaaatatgtaatgattagacggattaggtgtttcatctgagatgagtaactgtgtttgtaataaaatgtatttataaataagtatgatcatgaatatttaataactagtaaccacttgaatacatgtctttggccagaatatttacatatatatgtacctacactatataatacctattatgtataatttttatatatacactttatattatattacaatatagctgcaccttctgtggcttttgtgggctttattacccaccaaggtgtcagccatcaggtcctcaacagtggcagtgaggaaatcaggcgtgcatgggccaagccactgggcacagtggatctcccacgagaggggtccacagagttcagggggtatggcagctctgctcctgctgagagggtgccaggcagcttcctaagcctataggacctctaaaagtctcctttttctagacacaaggtttggtgaatggtgtggctcggatgttatttgtccccaacaaaactcatgttgagctgggtgtggtggctcacacctataatcccagcactttcggagactgagatggggggatcacttgaggtcaggagtttgagacaccagcctggacaacatggcaaaaccctgtctctactaaaaatacaaaaattagcccagcgtggtggtgcgcacctgtagtcccagctactcgggaggctgaggcaggagaattgcttgaacttgggatgtggaggttgcagtgagccaagatcatgccactgcattccagcctgggtgacagagcgagactccatctcagaaacacaaaaataaaaaatctcttgtgaaatttgatgccaatgtggcagggttgggaggtgggccctagtgggggattttaggtcatgggtgtggaccctcataaagaatgccctcttccaggggtgagttctcactgtcattatttcctgcaagggcaggttgttagaaagagtctggctctcttggtttctctcttgattcacctcttgccgtgtgatctctttgcacacaccttccactctccaccatgagtggaggcagcacgaggtcctctctagaagccgagcagatgccagccccatgcctcttatagttcgcagcctgtagaaccctgagctaaataaacctcttttctttatagattatccattcttaggttgtgtgatagcagcacaaaaaggatgaagacagggagctttgctccgattggcccagcttgatcctgcccctggcctgggccactcaagatgccagtgctcactcccaccgttgtgttcctgtgggccagcccctcactgggatgccattggtgtccacttggcctagaagtgcccatgataggaccctggtcatcctagtgaccaaacctaacctttcatttgactttttattgtagaaagaaatgcgttctggctggtggtagctcatgcctgtaatcccagcacttcgggaggctgaggcaggtggatcacttgagctcaggagtttgagaccagcctggggaacatggcaaaaccccgtctctagcaaaaatacaaaaaattagccgggtgtggtggcatcgcttatggccacagctactcgggaggctgaggtgggaggattgcttgagcctaggaggtagaggttgcagtgagccgagattgcaccactgcactccagcctgggtgacagagtgacctatctcaaaaaaaaaaaaaaaaagaaaaaagaaaaatgtgttcttcagtggaaaaccttaccctctttagaagataccacgccaggttatctgactctagtctgcactcaatgtgtgttttgcaaccctttttaagttttaggtcactgatagacatgcacaatgtgttgtccagtccagggtcaattttctctcctctcacagaggaaggaaatgagctttcttcccatttacatactcatttaaatactcctggttaatattcctctgtttgttggattctttttttctactggttattgtatctgctaatctcttataagttaaataaaatattttaacatgtgtttgtatctttatgagtgccagacttaatttttttaaaaagatgtattttaagcatttttaaggtcacaccaatatgcccaattgattcaactactaggaccagataaatttctatgacagaaagttgcatcaaatgcataactgaagcctgggcgtgtcttttcttggctctcctgcgtgactgcaaaacatcagtggaaatttgttgactctgcttttctcatttcaattttccattctgttaatttcatgttgatgagttttttgccacatttatagctgaaaagctgtttccacttttggcacaagggtttggagtttatttaattctttttattaagataaaatttatataacatttaatatattaatcatgttagaatttacaactcagtgctttttgttgtgttcacaagattttacaatcatcactatgtagttccagaacagtatgacacccccaaaagaaacctcacacccattaagtgctcgtttcctattgctcccctcactccccaaggccctggtaaccactaatccagtttctgttcctatggatttgcctattctgggcattttatacaactagattaataaagtctctggctttgatgtctgccttttgtcattgatcatgttgttttaaatagccgtccatatagaggcacatatcagtgcttcattcctttgtatggctaattgtccattgcatgaatgtgtctcggctgtgtatctagtcttccattgagggacatttgggtggtttccactttttggtgataatcaataatcctcgtatgaaaagcatatcaagtctttgtgtgggcatatgttttcatttctgttgggtatatcttcaggagtggaattgctgggccatatgataaccctatgttaaccttgggagaaacttccaaaatgttttccaaaatggctgcctcatttcaccaaccccccagcactgcatggggctctagtttcctcatgttttcccccacacttgtctgtcttctgaactacacccatactaacaggggtgaagtggatgttgagaatgtcttctgtgctcattgccctcttgtatcatttatttctctatcctgatgtgttgtcatcactaataattgaaagtcctcagaatatttatcccaagttaatttacacatgaaggacatttacaagggtataaaatgatttcctcagtgaatgtagttgtctcatttatttgcaatgtactggatgatagatttgattttcttattagcatactctgcaccctttttgaaataaaccatctgtcatcattttgtatacttagctagtaattttatgtcaaaattcataattcttcctggcctattttaaaagtttgggtatagtggatctaatagcacacacagtctttccatggcttttcttttttttcatgattaatgaaatggatttgaaagatgaatacctaaacttgaaaaacatgggaaaaagtgtcattgaaaacaatgaccacttttggtgaatgcttccaaatattaaaaaaaaaattttttttagtttctaattattcccagttgagttgagttgacacctcctaggagggcagaggctccgtttctggatcacactttctgtcacgggactgctcatagtggtgcttcaacctcggcacggggagagtaaataactgcacagtgtagaagcaatcaaggcagcccacataaactagagctatgcgactaacttaggagattgtctagtccttccacagcaggcagagctaagcctggatgccctggtcatggcccatgaggacaaaggggctgactgtgggaaaacaggcagtgatgagtgcagccatagaatggcaactatattatatagaaatcacttttctctgttttctaatttattaccataaggttgtttatattagtctctacgggtttaaaaactatcaattgttttaatcgtgtttattaatatttaagttagtctcttcatctttttctcaccattgcactaggtctgtgtattttatcataattttattccttttttgttatattctatgtaataattattctatattttactgtctaccttatgctttgttgttacacattactgtatttagcctatgcttctatgtataagttccagagactgacattaagcatgcatattgtcggcatcctttattctagtaattgaatttgcagttatcttattttgcctaaaactcttgaatcaaatagcgtgcacaactttgatttggaggagttatattgtcttctcgtgtaaaaaataatattaggaatattgcctagttttaatctttaaaatttaaaattctttaatatattatttacaaatattattacattataagtagcaaagctaatctctttgattaaaatattttatgcttggtaaaactttctttgaggccaggcgcagtggctcatgcctgtaatcccagcactttgggaggctgaggagggcagatcacaaggtcaggagatcgagaccatcctggctaacacggtgaaatcccgtctctactaaaaatacaaaaaaattaaccaggcgtggtggcaggcgcctgtagtcccagctactggggaggctgaggcagaagaatggtttgaacccgggaggcggagcttgcagtgagccgagatcgcaccactgcactccagcctgggctacagtgcaagactccgtctcaaaaaacaaaacaaaacaaaacaaacaaaaaaactttctttgatatacctaatgctaaatgatgagttaatgggtgcagcacaccagcatggcacatgtgtacacatgtaaactgcacattgtgcacatgtacttaaacaagtataataataacaaaaaaaataaaataaaattacattcaaactataaagttggagtttttatcaaaaagtacagacatttataataaaaacaaagtattttcataattaagccttgtaagttcctattttttttattttatatcaataataaccagcatgaaaaagcaaaaaaaaaaaaaacaactttctttgagaacaaaatatttcaatggtttcattgtgctgaaaaatgtgatacaaagctcagattcagcatatgtcaattaggacaagcatgtgtgtcgtattgttgaaaattttgaatcatcaataaatgttatctgtgttatcacaaatataatcacatcacaaagggtctgttaaagtttttcactgtggtcaaagaactgcacattttatcttatgattctgtcaaaagttcccccttactattcaaaccagcaattatcttccctaaaaaatgaagccatggccgtttttcccagataccttgtcttcagctcctccatggacagtggacggttccaccatagattccttcccaaagatcagaatgtgtggttcatcccacttctttctttggagcaggctaattgagattatcacttgagagataagaatacagaatattctacctccaaagtgttccaaaaaccagttggttttctctatgatccctctccctctttttttttttttttttttgagatgaagtcttgttctgtcacccatgctggagcacaatctcggctcactgcagcctcttgactcctggttcaagcgatcctcccacctcagcctcccaggtagctgggattacaggcatgcaccacctcacctggctaatttttgtaatttttagtagagacggggtttcaccatattggtcaggctggtctcaaactcctgacctcaggtgatccacctaccttggcctttcaaagtgctgggattacagacatgagccaccatgcccggccacaattctaatatttattagctgtgaatcaagttctaattaaaacttcttgataagattcttggctgggcatggtgggtcaggcctgtaatcacagcactttgggaggccgaggcaggtggatcacctgaggtcaggagtttgagacgagcctggctaacacagtgaaaccccgtctctactaaaacttataaaaattagccgggtgtggtggcaggcgcctgtaatcccagcttgtcgggaggctgaggcaggagaatcgcttgaacccaggaggtggaggttgcagtgagccgagatcacaccattgcactccagcctgggaaacagtgagactccgtctcaaaaaaaaaaaaaaaaaaattcttgtgctcactttgccccacccaggccattctgtttacttttacctgaaaatatttgaaaaatatgctactctcttcccaccaaaaaatcacatatctcaaatgattaactttcttttcaggatttaaggtaaaatgacaaaactggtctttgatgtcctgcagtatctgatacaccgttttccttcatgcttcattccaggccacttgctgtggtgttcctgcttttccttttcactttcttgataagcaattactcagtcttttccattttattaaactcttcttatatttctgtgtccagttaatttcaggatatttttaattaatcggttctacattacatactcgtataagctttccattgtctccaagttattagaggcccatttaaaaaagagaaaagagtttttagcttctaaacttctccactaaaatgtttaataaatgaaagttataccagcactttgggagaccgaggcaggtggatcacctgaggtcaggagtttgtgaccagcctggccaacatggtgaaaccccatctgtactaaaaatacaaaaaattagctgggcgtggtagcgggtgcttgtaatcccagctacttaggaggctgaggtaggagaatcgcttgaacctgggaggcggaggttgcagtcagccgagatggcgccactgcactccagcctgggtgacaagaatgaaactcagtctcaaaaaaaaaattataaaatcattttcaaaacatttagtctacacctgccattctcaccccatgacaatcctacgaaggcagaggatctgtttccagatcacactctctgtcatgtgactgctcacagtggcgcttcaacatcggcacagggagagtaaataactgcacagtgtagaaacaatcaagacagcccacataaattagagctatgcgactagcttaggagattgtccagtccttccacatcaggcagagctgagcccgaatgccctggtcatggcccatgaggacaaaggggctgactgtggggaaacaggcagtggtcagtgcagacgtgttcaccagccaccagctggggttagggtacttagccaaaaatggtgtgaagacagaggagagggtatagaatgatgcaaaggtgctcactagaacaaggatgctttgggtcactctgaactcaggggaggacctggtggggaggttagtcctgtgaaggtgttggacccactccctgtgcctgtgccgaataaagaccatggacctgctggcccaggtcatgaggcccaaacacaaaacatcgtaggatcatgacaacgttgtatgtagtaatcctgtaattctgttattacttactgcacaacaatatcccaaatctcttttccgtgtgttatgtttgttactccacttgtcagtcatactcctaagaaaaatggtatttaccagcatgttcagcacctagcacaggagggtgaaggccccaacgtatctgggagcttatagtttcagctctgcccacgtggaatttgtggggccgatcgtgatggcctggaagatactcagaaatcaggtggtgcccatgcacacacccctgcccactctgtggaaacagaaaacaaatttgcacccaatgtcactgaggaaatggccattgtttgtgggactcctttagagagaatgaccaaggagttggctatagtcaggtgctggagaatcagatctgtggactttaatgtgcatctggtgaaataaaggaaactataatgataaagaagaaagcaattgcccaggaatcctactgtggcctgagataagaagatcattcctattgtcacatccctggaggccatttgccatttttcaatgactgatcatcctattcagagtgagaagatcctgcatgaaaacaggaggcctgtggtaccatgacaactgaaatccactcttgtggaccatagttttcaaaccattaatttcctattaaatttcattttcctttttctgagagttttgctataaaaatatatatgtgtatatagatacatattcctagcataagagtgttataacagtgttttatgtataactgttacaacaattctctgaagggctttattgttcccatttgacaggtgaggcaatcttgggcacaggaaagctgaatgacactcccaaagtcacttccttgtaagaggcagtgtcagaagctgctagtgtacttgaccactatgctgtcttagcagcagatatatttatttatttatttattttgagatggagtggagtgcagtggcaccatcgcggctcactgcaacctctgcctcccacgttcaagtcattctcccacctcagcctcccgagtagctgggattacaggtgcgtgccaccacacctggctaatttttgtatgtttagtagagacagggtttcaccatgttggccaggctggtcacaaactcctgacctcaggtgatctgccctccacggcctcccaaagtgctgggattacaggcatgagccactgtgcccggcccagatatatttattttttaaaacaatccacatacttaaaaaaatattttgtatctcttgagtttttaaaagaatggttgtgagtcttgtttttcttttcaattgtgattgaaaacaacattgcttgttttctaggcaaacattatagtgattagagatccaagtaaaatatagatgggctgattttagtataaccttaaaagaataattatataaaccaaatggaatttattgaatgcacaaatggaattaaaagaggaggttcttttccatcttaaccaggaaggagcatacaatagaatgggcatgcgctaagcaagggagcaggaaaatgagtaggagggaaaacattgcaggagaaactaaattaccatgagtgtagaaagaaaatgagtatttgtgaatgcaaaaatatcaaatatagtatttcaatgtcagactggttcactatattaaaacacgagtccaccatgcaaaagaaaaactagaggtaaagattgtacattgactcaaaatagtactaagatgagcactgagactgcgaatggcatgaaaacatttttacaccagaggaaagatcacaaaataatgcaattctgaaaactgctgaagagtgtaacttttttcctgaatacaaaaacctaaggtcagttacctttctttgctgatttcatgaaggaaaacagcctcaccataataaagagacaacagattttttttctgtcacggcacagttacggtctccatttggtatattctatgcacagagttggtgaaaacactatatttactatttctgaacagaataagataattcaatcagctacatcttatacatgatcacaggcatggaggtgtcatggaaacaagtctacaaatcttagaaatgttcatgtagataagagagagcagctggcaaattaatttccaaattatattagagaacttaaaaataggccgggtatgatggctcatgcctataaccccaaaacttttggaggttgaggcaagaggattgcttgaggccaggagaccagcctgagcaacatagggagagcctgtctctacaaaaaattttttaaaatttgctgaatgttgtggcacatgcctgtggtcccagctactcggaaggctgaggtgggaggatcatttgagtcaaggctgcagtgggccacaattgtactctggcctgagcaacagaaagagaccctgcctcaaacaaacaaaaaaagatttaatgactttattgaaaccaacaatgatgaacagcgaggattacattaaatgagaagcagttaggggctggtttatggtcttgacctccattccttctccatgagtccagcccatgacccagtgattatttccctttccctgcattgtgttggcactgacttagtttctagcccagaagattcccatttcccagacaaaagcctttgctccatctcccagtacacttccttctggtgcaggctatgccttctagactgaaatagaaaatactcacctgatttttcccttgctgctgggacaatgcaggtttatgctcaggacagccagcagatgagtgtgcggagggaggcagccagctctcagatatgggtttttgtcctgtgacctcaccatttctcagcacttcaatgagcatttcacctgtggcaacaatgacagtgcacacttggggagctaaagatagtttaaagaaactttgtcacagttaccaatgaccaaaaacaagtataattttctagtgagcatctccagagagatgagagtgtttggcagaggttcttgctttccacgatcccttggaggcaacaggaagaggctcccaaggagggagcaggaagggctgagtccagactgaggggttggcagcagagcacacgcgtcttgccggagtctgtgctttcctgagatggtctcctatggaaaatccaattttctgctaatcctcagattcctgagccaaactatcatttgattatgaatagagaaatgggatcatgccaagaacttgagaaggatgtgtcagcaggttacagtgcaaacagcaacttgaagtccaatactgataggaaaaataaatggaaacaaatttgggcaatccaatgtaacttaacctgcaaatgtagatgttatatattctataaatatatattttatcaacatttacccccagagagatagaagttctaaattgtacaatatatataaaagaaacagacgtttatcagagtccctcacatacacaaaagcaccaagttcatatgatccagaaaggaattctactaatgaactgattgataaactgatgctacctaaactatttgaatcttaaagtagtctatcttcccaatagtttttaggaaaggtgcataaaggtgatatgagaacttaccatggtttgagccacatattacaaaaatataggacatatgaatataactataaaaaatttaaatattagaagcaattggctaggtgctgtggctcacgcctgtaatcccaatggtttgggaggccaaggcaggtgaatcacctgaggtcagaagtttgagacaaacctggccaacatggcgaaaccccgtctctactaaaaatacaagaattagctgggcgtggtggtgcacacctgtaatcccagctacttgggaggctgaggcaggagaatctcttgaacccaggaggcagaggttgtagtgagccgagatcgcgccattgcactccagcctgggcgacagagcaagactctgtctaaaataaaataaaataaaataaaataaaataaaataaaattaaaataaaataaaaagccattagggcagtcaccaatgttctatgagggatgtgtcttggaagaaaaagtctcttctgtaaggattactcaactggtacatgggcaggcaaggtgatccctagtggcctgccagtcttaagaaaaattttatgcatctagggaaaaattggtcacaaccaggcaattagatcgcagcctccccaccaagtaaaacaaaattctgtgttaagcacatgtaaaacaaaacaccagtacaaacccaaaatattttctcataggcattgtagagttttttgtttgttctgttttttgctctcgagagattaataagcagaatgggaccctcaaatttcaaagcatgcaataatggtccccccactcctgggacccctgccaggtatatgtttaaaaactaattcacaactgattttggctgggcgcggtggctcacacctgtaatcccagcactttgagggccaaggtgggcagatcgcctgaggtcagaagttcgagaccagcctggccaatatggtgaaaccccatctctactaaaaatacaaaaattagctgggcatggtggtacacgcctgtaagcccagttactcgagaggctgaggcaggagacttgcttgaacctgggaggcagaggttgcagtgagccaagattttgccattgtaatccagcctgggcaaaaagagtgaagtgaagctccatctcaaaaaaaaaaaaaaaaaaaaaaaaaaaggaaaaaagaaaaattaaggtcctctgtcttgcatgttttaatttttatttgtataaatttaagcggtacaagtgtagttttgttacatggatacactgggtggtgatgaagtttggtttatcacctgaatagtgcacattgtatccaccaagtaatttctcatcccttacaccctcccactcacccacccttctgagtctccaatgactatatatatatatttttttgagatggagtttccctctgtcgcctaggctggaatgcaatggcgggatcccggctcactgcaacctcccgcctcctagattcaagcaattctactgcctcagcctctgggtggctcggactataggtgcacgctatcacacccggctaatttttgtatttatagtagagacggggtttcaccatgttggccaggctggtctcgaactcctgacctcaggtgatctgcccactttagcctcccatagtgctgggattacaggcttgagccagcgtgcctgacctccaatgactattattccactttctatatccatgagtacatgttatttagctcccatttataagtgagaacatggaatatttgactttgtttcttttattttacttaagataataacctccatttccatccacattgctgcaaaagacatgatttcaaggctgggcatggtggctcacacctgtaatcccagcactttgggaggctgaggcgggtggatcacttgaggtcaggagttcgagaccagtctggccaacatggtgaaaccctgtctctgctaaaaatacaaaattagccaggtgtggttagtgcatgcctgtattcccagctacttgggaggctgaggcaggagaatcacttgaacctaggaggtggaggttgcagtgatcctagatcttgccatcgcactccagcctgggcaacaagaatgaaactctgtctcaaaaaaaggacatgattttatttattttttaattttgtagtttatcttagatataggaatacatgtacagatttgttagatgggactattgtggattttattctttttatggctgaagagtaatccattatatacataccacattttctttattcagtcatccattgatggacaatagcaaagatatggaatcaatctaagtgctgctctgagcatacaagtgcaggtatctttttgatataatatttttcctttgtgtacatatccagcagtagaattgctggatcgaagggtagttctatttttagttctttgaaacacttacatactcttttccatagaggttgtactaatttagttcccactaacagtgtataagtgtttccttttctccacctcctcaccagaatctgttattttttgactttttaataattgccattctgactggtgtgagatagtgtctcattgtggttttaatttgcatttctctcatgattaataatgttgcacattttttcatatgcttcatggccatttgtatggcttcttttgaaaaatatctgttcatgttctttgcccactttttattttatttatttatttttagtataatctgtacaacaatctttgcccgctttttggtggggttattttttttttggtgtgtgtatggagttgctttagttccttggaaattctaggtatcagtcctctgtcagatgcatagtttgcaaatatttcctcctattctgcaggttgtctattcactctgtttattatttcttttgttctgtagaagttttttagtttaataagacccatttctatatttttatttttgttacttgtacttttgaggtcttactaataaattctttgtgtggacaaactgttcaaaagagttttgcccaggtttcttctgctatgtttatagttctacaacttatatttaagttttggtccatcttgggttgatttttgtatatggtgagagatatgtgctcagtttcattcttttggatataaatacctgattttcccagcctccctgagtgaaaatggtgtcctttttccagtgtatatttgtgttgattttgtcaaaatcagttggctgtagacatgtgactttatttttggcttctttcttttgttccattgatctatttttatacctgtaccatgctgtttggttgctatagctttgtagtataatttgaagccatgtaatatgatacctgcagctttgttctttttgcttaggattgctttacctcttcaggtttttttggttccacacgaattttaggatttttttttaattctgtgaaaaatgacattgatattttgatagggattacactgaatctgtacatagctttgggcagtatagtcattttaatattacttcttcagatccataataatgggatattttcccacttgtttgtgtcatctacaattacctcatctttgttttgtagttctccttgtggagatctttcacgtccttggttaaatgtattcctaggcagtgggagagaatgataattgtggggatggaatttaaacattatgtatttaagataaaaaatattgtctcaaacctgtaatcccagtactttgggaggccgaggtgggtggatcacgaggtcaggagatcgagaccttcctggctaacacagtgaaaccctgtctctactaaaaaaaaaaaatacaaaatacaaaaaattagccaggcatggtggcgagtgcctgtagtcccagctacttgggaggctgaggcaggagaatggcgtgaacccgggaggcggagcttgcagtgagctgagattgcgccactgcactccagtctgggcgacagagcgagactccgtctcaaaaaaaaaagaaaaatattgtactgagcttatgatttgggggaagtttccaagtcatttaatatagtaagaaccttttctgtcatctttgctaaggctgaattgcaatgttatcatctttagggccccaaaagtaattatgttcacagatttttaatgctttaatctcatgtgtttattagacagtgaatgtttacttaaaattaacccctgacattttccaaattgactcacaaattggataaaagttatatatgcttttatctttaagtctactttaaaagagagtcttaaatttagaaatgccagaatgtatttacatgtttgtaattcaaaatggagtttctgcaaacacttaatttccaaattatatcaatgacatttaaatagattataattgaaatttgatgctaggagtaataatcataatgcaaattagttagaaaagttatgactgctcaaatattactgtcttacaaattacttataattatcatgccgaagttttgacacccatttaaaattcagtttcttagagatttaagcattataaggaaataagaatactctcttcttgtatagatgttaaataaaatatcttgtttcctttaaagatccaagaaattaaaatagcattttataacatgacttatgatagtcaacaatcatgtctttttttaaagaaaattgtaaaaattatttgaatccatgaatattgtttgttctcatttctctgaagccatattaggctaattttgagtgtcaaagttactccatcatgtggttttgagtgttaaaagcaaaacaaatagaagtgaatattctggccaggcacagtggctcacgcctgtaatcctagcactttggaaggctgaggcgggcggattacttgaggtcgagagttcaaaacaagcctggtcaacatggtgaaaccccgtctccactaaaaatgcaaaaagtagccagacatggtagcaggtgcctgtagccccaccacttgggagactgaggcaggagaatcgcttgaacctgggaggcagaggttgcagtgagctgagatcatgtcactgcattccagcctgagtgacagagtgagactccttcacggaaaaaaaaaaaaaaaaaagaagtaaatattctgtggtaacataatagttttttaagcaggacacacattgaccaaatatcttaaattttctttctaagttgttatgaactcccccacatgaaatagtagtcagttatataataaaagttttactgttcttattgaagttggataattaacagcagagtaagctcaactaatttacatgggaaaagacaacaatagtataaataaatttccttcatttgacaccatcaaacaaagttgtttaaactttctcgttcgttttcacatcgttatctcttcaatttatccaaagcatttaaaatatgttcttgttattcttcataataggtaccctgtgagatactgatttttcttttttaattattaacaggcaagaaaacgagagctcaaacaggatgaatttcaagatggcaatggcagaactcaaaattgcatttgtcagtgtccaaaaccactgttcttccacaagtcttttttatatagaattctttttctgtaatctattttgtttatgatagctaaacattcagtttcatttatattatgtattttatcttattgtttttatagtattttctttctctccatacattctaatcagtttattcacatggtcaaacattaacagcagatatttatgacaatttctatttaaaaaccttaaacattgattacattttcaattattttctccatacaggcatacctcagaaatattgtgcgttcagttccaaaccacaacaataaagtgaatattgcaataaagtgagtaacacagactttttggtttctgacacatagaaaagctatgtttactctatagtgtagtacattaagtgtgcaatggcattatgtctaaacatcaatgtacataacttaattgaaaatactgtattgctaaaaaatgctaataatcatctggaccttcagcaagttataacctttttgttggtggaagctcttacctcaattttcatggctgctgaccaatcagggtggtggttgctaaaggttggggggctgtggtaatttcttaaaataagaaaacaatgaagtttgctacatttactgacatcttttaagggaagatttctctgtagcatgcaatgctgtttgatagcattttaccctacagtagcatttctttcaaaattggggttcaccttatataaccctgccattgcttcatcaactaaatttatttaatatttgaattcctttgcagttatctaaacactgttaatagcattttcttggctcatccatgtaaatcattctagaagatccattaaaattttatgatgagattgcagcaattcagtcacatcttcaagctccactgctgattctaggtctctttctatttccaccacagcagtgcttccttcttccactaaagtcttgaatccctcaaagtcatcaatgaaggttggaagcaacttcttctaaactcctattaatgttgatattttgacctcctcccatgaatcacaaatattctttttttttgtatacatagagatgggatcttactatgttgaccaggctggtgttgaactcccggcctcaagcaatcttcccatctcagcctcccaaagtgctgggattacaggcatgagccaccgtgcccagcctccatgaatcacgaatgttcttaatggcgtctagaacagtacattctttcttttttttttttttttacttatttatttatttatttattattattatactttaagttttagggtacatgtgcacaatgtacaggttagttacatatgtatacatgtgccgtgctggtgtgctgcacccactaaatgatagactggattaagaaaatgtggcacatatacaccatggaatactatgcagccataaaaaatgatgagttcatgtcctttgtagccacctggatgaaattggaaatcatcattctcagtaaactatcacaagaacagtacattctttctaaaaggttttaaatttgctttgcccaaatctctctgaggaatcactatctgcggcagctataatcttatgaaatttctttctttttttaattaaaaaaaatttaatgttggtgggtatatagtaggtgtatatatttatggggtacatgagatgttttgatacatgcatgcaacgagtaataatcacatcatggagaatggggtgtccatcccctcagcatttatgcattgttacaaataattcaattatactcttttagttattttaaattgtacaattaagttactgttgagtatagtcagcttgttgtactatcgaatagttgaaatttatttctcagataatatgacttggaagtcaaatttacttcttgctgatccatgggctgtagaatggatattctgtgagcagacctaaaacaatatgaatctccttgtgcatctctgtcatagctcttgggtaactaggtacattatcaatgtatggtaaagttttgaaaaaaatatctttttttctgagcagtaggtctcagcagttggcttaaaatattaagtaaaccacactgcaaacagatatgctgtcatcaggctttgttccatttccagagcaaaggcagagtaggtttagcatcattcctaaggtccctaggattttctgaatggtaaatgagtactggcttcaacctaaagtgtccagctgcattacccactaataagagagtcagtctgtcctttgaagctgtgaaaccaggcattgacttcacttcttagctatgaaagtcctaggagacatcttcttccaatgcaagactatttcagctgcactgacagtctgtcatttggtgtggtcactttcctcagtgaccttagctagatcaaggtaacttgctacagcttctctatcagctcttgctgccttgccttgcactttcatgttacggaggtgacttctttccttaaacctcatgaaccaacttctgctaacttcaaacttttcttctgcagcttcggtcacttcctcacctctctcagcttttacagaattgaagagagttagggagtttctctggattaggctttggcttaaggaagcgttatggctggtttgatcttctattcagaccactcaaaatttctccatatcagcaataagactgtttgctttcttatcattcatgtgtttactggaccagcacttttgatttttttcaggaacttttatttgcattcacaacttagctaactgtttggtgcaagaggcctagctttaaggctatctcagtttttgacatgtcttcctcactaagcttaataatttctagcttttgatttaaagtgagagaaatgcaactcttccttttatttgaatacttagagaccattttagagctattaattggcctaagattgttgtgtctcagggaatagagaggccaagggagagagatggcaaaaagagaagaatgggtggtcaatgtagcaggcagaacacatgcaacacatattgattaggtttgctgtcttctatgggcacagttcatggcaccccaaacgagtacagtattaacatcggaaatcacgaattacagatcaccataacagatataacagaaaggaaaaagtttgaaataatatgtgaattaccaaaatgtgacacacaggcatgaagtaagtacacgctgttggaaaaatgatgccaatagaagtgtttgatgcagcgttgccggaaaccttcaatttgtaaaacactcaatatctgcaaagcacaataaaatgagggatgactgtatactgttcaatatttttttacttattatgaacatggtgcttttttaaatgatttttttgagatgtatctaaatagctgcaaagacattcattgtatgaatgtacaataatttaatgtaacaactatttttaatttttctaaaatatatttaaaaatttttaaatcacccataatattattattgaaattcatgtaaagcagtaaaagcaattagctgggtgtggtggcatgtgcctatagtcccagctactcaggaggctgaggcaggagaattgcttgatcctgggaggcagaggttgcagcgagccgaaatcgcgccactgcactctagcctgggcgacagggcaaacaagactccatttcggaaaaaaaaaaaaaaaaaaaaaaaaaggcagtaaaagctccctcttctgttcatgctgtaattttcccaaaggttaactttcttgtgtggatctttcacaataattttctaagtttgtaattatacatcaataagtatgtatgtagatctgacacagatctcagtcaccggtttccttagcgcacctgtctcatgtatccttggccatctactctgccaccagccatgccctgtggtttcctgctcaggcccaagtagctttgctgcctggtgacaaccagtgtgctgtctgtcctaggagtatagcctctgatacacagccaggtccagcagtgattgcccagagattccagctttttcctctgtaggaactagcaacccataaaatagcttgggctttggcatttgaactcactattgaaagaatgatgcattctggaggtatgagggagttaatgtcctatggggaatactttgtcaatggaaaaagaaggtaggaggaagctgagaaattaagcttctcttcccataatctactctgaagtgggatacctatttttggctcatccagaaaagtgttctatctcaagcagataattgtttcccactaatttactatagttttgtggtttctcataaagtaataaccactgactcccatttctagccaaccttatttctctttctcttacctatgctgccctttttctcacctccaaaagaaaacatctaatacgtgtatcagaaaacacaatataaaataatagatatgtacacatgtgtattaaaaaattaaacagaacaaatattaaacaaaatagctctgaaccatccatcatttcaacaagaaatcacaagggaaattagaaaatatctggagtggattgaaaagaataacacaataaatcaaaatacatggaaagaagctaaagcaatgcttacagggaaacttatgaattcaaatgttttgctagaaaggaagagcgtctcaaatcaattacctaatcaacttaagaaacaaaaacaaaaacaaaaataaataaaataaaagaaataataataatcagaacaacaattagtgaaataggaaacacaaaaacaatagagaaaacaatgaaacctaaaattgtatctttgaaataacgcaactggtagagattttactggactcatcaagatgaaagagagaaggcacagattgtcaatatcaggaatgaaaggcagaaccttacaacagattcaacagaaatttaaaaagaatttaaggctgacatggtggctcacgcttgtaatcccagcactttgggaggttgaggtgggtggatcgtttgaggtcaggagttcaagaccagcctggccaacatggtgaaaccctgtcactactaaaaatacaaaaaaaaaaaaaaaaaaattagccggggtgtggtggcacaggcctgtagtcccagctactgggaagactgaggtaggagaatcgcttgaacctgggaggcagagtttgcagtgagccaagattgtgctactgcactccagcctgggtgacagagcaaggctccatctcaaaaaataaaataaaataaaataaaaaaagtaaggtaatgatgaacaactaatatcaacaagtttaacaacataaatgaaataataaaattcctagatagatattaagtagaaaaactgacttaaaaacaaaatagaaaatcttaatagatgtatataaagtaaaaaaaaattgaattagtaactaaatatattcccctgaagaagagtgtagtgccagatggcttaacctgtgaattccatctaatatttaaggaagaaagaataccagtcatacacaaacattttcagcaaatggagaaaagagcatatgcccaaacattttagaaagccagtattagcttgataccaaggcaggatggcgacatcagaggaaaagcaccaagcaatatctgtcataagtttacatgcaaacatatttaacaaaacggaagcaaattaaatccaacaacatgtaaaatggtgatacactgtaactctctggaattaatcctagtaatgcaaatttggtttactatctaaaacccaatgaacatagtacatcatataaataaaataaagtagtaaatcaatagaatcatctcaaaagacataaaagcattttgacaaaatccaatgctaatttctgataactcacaacaaacatacgtaaaaaagtgaaaaaaactagcataaaggacagaggagagtaattggaattataccattttaaggctcttgccttaaacaaaaatgttaaaatattaattcaagatagactatgataaagatacatattgcaatctttctttctttctttctttttttttttttttttgagacagagcctagctctgtcacccaggctggagtgcagtggcaagatctcagctcactgcaacctccacgtcccaggttcaagcaactctcctgcctcagcctcctgagtagctgggattacaggtgcctgccaccatgtccggctaatttttgaatttttagtagagacagggtttcaccatgttggctaggctggtctcgaactcctgacctcaaatgatctgcccgcctcggccttccaaagtgctggggttacagtcgcgagccactgtgcctggcctacatattgtaatctttcaattaacaaaaaaaatgaaaacaaacagatatagctaagaagacagcagaagtgataaaacagaagactaaaaaataggcacactaaagaaagaatagtttaaaaaaaagaagaaatagaaaacaaataacaacagggtacacttaaacctagtcattttcaacaattacattaaatataaaagggcccaggcttcatggctcatgcctgtaatcccagcactctggaagctgaggtgggaggatgacttgagaccaggagtttgagaccagccctggcagtgagatgctgtctctgtctctgcatgcactgtgttttttttgtttttttttgagggagtttcattctggttgcccaggctggagtgcaatggcacagtctcagctcactgcaacctccgcctccaaggttcaagcgattctcctgcctcagcctcccgagtagctgggattacaggcatgtgccaccacgcccagctaattttgtatttttagtagaaacggggtttctccatattggtcaggctggtctcgaactcctgacttcaggtgatccacccgcctcgtccttccaaagtgctgggattacaggcgtgagccaccgcgtgcccggtcaaaattttttttttctttgagacggagtctcactctgtcgcccaggctggactgcagtggcgcgatctctggctcactgcaagctccgcctcccgggttcatgccattctcctgcctcagcctcctgagtaactgggactacaggctcccgccaccatgcccggctaattttttgtatttttttttagtagaaacggggtttcactgtgttagccaggatggtctcgatcttccgaccttgtgatctgcccacctcggcctcccaaagaaaattttttttaaaaaataaaagattagctgggcatggtgccatgtccctgcagtcctagctactcagaaggctgaggcaagaggatcctttgagcccaggagtttgaggttacaacgagctatgatcatgctactgcagcccagcctgtgtgacagagccagaccctgtttctaatacataaataaatatagaagggctggatatctcaatttcaaagttcggattacttatgagattaaaaaaaataaataagacccaaccctatgctgttcacaagaagcatattttagatatagaaacaacacgtaggcaaaagtatgggtataaatgtgtcatacaaatgctcatcctaaaagaattggtgtgcccatattaatattagataaagtggtcttccaaacaggagtactgccaaagataaaggggtcaagtcacaatcaaaataggccagttcataagattaacaatcttaaatgggtgagcctaatgaaacttcaaaatgtgtgaaacagacatcaacagtaaaggtgacgataatcagatctacttttttaagtgtctgtggaacattaatcaagacagatcaaatactggaccataaaacaattctcaataaatataaaatgatttaaatcatagagggtttgtatactgagcaaaataggactaaattaaacatcaacaacaaaaatatactcagaaaaccttaatatttggcaattgagcaaagaacttctaaataacaatgaataattctcagatatatatgttaatttttttattgtgttaaaattttaacaattttaagtatataattcagtagcattaagtacattcacagtgttgtacaaccatcctattaatcacaagccaaaataaagtacccattaaacagtgactcaccattacttcctttggtattttaggtagagtatataatatatatttcgtgtactttgatattttatgtacagtatataatatgtaattggtgtaatttgatattttatgttcagtatataatatgtatttggtgtactttttgatattttatgtacagtatataatatgtattttgggtactttgatattttatgtacagtatataataagtatttggtgtactttgatattttatgtacagtatataacatgtatttggtgtactttgatattttatgtacagtatataatatgtatttggtgtactttaatattttacatacagtatataatatgtattttgtgtattttgatattttgtgtacagtatataatatatattttgtgtactttgatattttatgtacagtatattatatgtgttttctgtactttgatattttatgtacagtatataaaatgtatttggtgtactttgatattttatgcacagtatataatatgtatttggtgtactttgatattatatgtacagtatataatatatatttggtgtactttttgatattttatgtacagtatataataagtagttggtgtaatttttgataatttaagtacagtaaataataagtatttggtgtactttttgatattttatgtacagtatgtaatatgtatttggtgtactttttgatattttatgtacagtacataatatgtatttggtgtactttgatattttatgtacagtatatagtatatatttggtgtactttttgatattttatgtacagtatataatacgtatttagtgtactatttgatattatatgtacagtatataagatacatttggtgtactttttgatattttatttacagtatatgacatgcatgtggtgtactttttgatattttatgtacagtatataacatgtgtttgctgtactttgatattttatgtagagtatataatatgtatttggtgcactatgaaattttatgtacagtatataatatgaatttggcgtactttgatattttatggacagtatataataggtattttgtgtagtttgatattttatgtacagtataaaatatgtatttggtgtactttgatattttatgtacagtatataatatgcatttgatgtagtttgatattttatgtactctatataatatgtatttggtgtattttgatattttatgcacagtgtataatacaccaaatacaatttatatactgtacataaaatatcaaagtacaccaaatgcattttatatactgtatataaaacaccaacgtacaccaaatacatactatatactgtacatagtttgaaagtacaccaaatacatattatatactgtacataaaatgtcaaaaagtacaccaaatacatattatatactgtacctaaaatgtcaaaaagtacacgaaatacatattatattctgtacatatattatcaaaaagtacaccaaatacatattatatactgtagataaaatatacgaaagtacaccaaatacatattatatactgtacataaaatatcaaaaactacagcaaatacatattatatactgtaaataaaatatcaaaaattacaccaaatacatattatatgctgtacacaaaatatcaaagtacccaaaatacatatgatatactgtacataaaaaatcaaagtacaaaaaatacatatgatatacagtacataaaatatcaaagttcaccaaatacatattatataatgtacataaaacatcaaactacagcaaatacatattatatactgtacataaaatatcaaatagtacaccaaatacatactatatactgtacatcaattatcaaagtacaccaaatacgtattatatactgtacataagatatcaaagtacacttaatacatattatatactatacataatatatcaaagtacacaaaatatatattatatgctgtacatataatatcaaagtatacataatatatattatacactgtacttaaaataccaaagtacacaaaatatatattatatactgtacataaaatatcaaagtacaccaaatacatattatatactgtacataaaatatcaaagtacaccaaatacatattatatactgttcataaaatatcaaagtacacaaattacatgttatatactgtacataaaatatcaatgtgcaccaaatacatattatatactgtacataaaatatcaaagtacacaaaatacatattatacactgtacataaaatatcaaagtatgcaaaacatatatactgcacataaaatatcaacttacacgaagtatatattatatactgtacataaaatatcaaagtacaccgaatatatattatatactgaacataaaatatcaaatcacacatattatatattatatactgtacataaaatatcaaagtacaccaaatacatattatatactgtacatgaaatatcaaagtacaccaaatacatattatatactgtacataaaaagcaacgtacacaaaatatatattatatactgtacataaaatatcaaagtccaccaaatacatattttatactgtacataaaatgtaaaaaggtacaccaaatacatattttatactgtacataaaatatcaaaacgtaccccaaatacatattatatattgtacataaaatatcaaaaggtacaccaaagatatattatatattgtacataaaatatgaaaaagtacacctaatatatattatatcctgtacatcaagtatcaaaaagtacatcatatatattatatactgtacatcaaatatcaaaaagtacattatatattatatactgtacatcaaatatcaaaatgtacaacaaatatatattatataatgtacatcaaatattaaaaattaaccaaatacatattatatactgtatatcaaacatgaaatagtacaccaagtacttattatatactgtacatcaaatatcaaagtacacaaaatacttattatatactgtacacaaaatatgaaagtacaccagatacatattatatactgtatataaaatagaaaagtaccccaaatacatattatatactgtacacaaaatataaaattacagaaaatacatattatatactgtatataaaatatcaaagtacacaaaatatgtattgtatactgtacataaaatatcaaagtacaccaaatatatattatttactgtacataaaatatcaaacataccaaatacatactatatactataactaaaatatcaaagtacaccaaatacataatatatactgtacataaaatacctaagtacaccaaatacatattatatactctacataaaatatcaaagtacacaaaatacatattatatactgtacataaaatatcaaagtacaccaaattcatattacatactgtacataaaatttcaaagtacaccatatacatattatatgctgtgcataaaatatcaaagtacacaaagtacatattatataccatacataaaatatcaaagtacactaaatacatattatgtactgcaaataaaatatcaaaatacacaaaatacatattatatactgtacacaaaacatcaaagtacagaaaatacatattatatactgtatgtaaaatattaaagtacaccaaatacatattatatactgtacataaaatatcaaattacaccaaatacatataatatactatacataaaacatgaaagtacaccagatacatattacatactgtacattaatcatcaaagtacaccagatacatattatatactgtacataaaatatcaatgtacacaaaatacatattatatactgtacataaaatatcaaagtacaccaaatacatattatatactctatataaaatatcaaagtacaccaaatacatattatatactgtgcataaaatatcaaagtacacaaagtacatattatatagtgtacataaaatatcaaagtactctaaatacatattatatactgtattcaaaatatcaaagtacacaaaatacatattatatactgtatgctaaatattaaactacaccaaatacatattatatactgtacataaaatatcaaagtacaccaaatacacattatatactgtacataaaatatcaaactacaccaaatacatattatatactgtacataaaaaatcaaactacaccaaatacatattataaactgtacataaaatatcaaagtacacaaaatacatattatatactgtacataaaatatcaaagtacacgaaatatatattacatactgtacctaaaatatcaaagtacacgaaatacacattaaatactgtacctaaaatatcaaaatacacgaaatacatattatatactgtacctaaaatatcaaagtacacgaaatacatattacatactgtacccaaaatatcaaactagacgaaatacatattatatactgtacctaaaatatcaaagtacacataatacatattacatactgtacctaaaatatcaaagtacaccaaatacatattacatactgtacctaaaatatcaaagttcaccaaatacacattttatactgtacctaaaatatcaaagtacaacaaatacatattacatactgtacctaaaatatcaaatacaccaaatacatattacatactgtacctaaaatatcaaagtataccaaatacatattatatactgtacataaaatatcaaagtacacaaaataaacacttatctttgttctgtcttcacaaatttgcctattgtagatatttcatatcaatggaatcacacaacatttgtctttttatgtctggcttacctcacttagcatcacgtttccaagtttcacccatgttgcatgcatgagaacttcattccctttaatggatgaataatactctattatatatgtatcatattttgtttatccattcatttgttgatggacatgggctgtccctgccttttggctatggcaaataatgctacaataaactttggtgtaaaaatgtctgttccagatcctgctgtcaacttttttgtgtgtaatacctaggagtggcatttctgggtctatgtgtgattctgtgaggaaccaccgaactgctctccacagcaactgcatcattttctgtttttagcagccaattcatgagggcttcattttctccacatccttagcaacatttattttctgtttcattgttgttatgaaagccatatcggaggatggaaagtggtatttcattttggttttgatttgcactttattaatgaataatggtgtttagcattttttttgtccttattagacatttgtatattttctttggagaaatgtctattcaagtcctttgcctattttttaattggaatgttagaaattttgttgttaagttgtgcgatattaagcttttatcggatatatgttttgcttttatcagataaatattttctcacatactacgggtggtcttttcactcccttgatagtgtcctttgatgcataaaatttttcgattttgattaaatctaacgtgttttttcttttgttatctgtgcttttgtgtcatatttcaaaaagcatttaaaactcaaaggtcataaagatttacgtgtgtgttttcttctaagagttacatatttttagtccttacatttaagtcttttgttaatttagagttaatttttgtatatagtgcaaggtaggggtctaacttcactcctgtgcatggatatccagctgttgaagagagtgttctttcctccattgactggtcttggcctccttgctgaacagtcattgaccatatatatgaggactaatttctaggatctcaatcctattctgttattttaaatgtctattgattttatgccagtaccacaccctcttgattactgtagatttgtagtaggttgtgaaactggaaaatgtgagttttccaatgttctttttcaagattgttttgtctatgtcagattctttgaatttttgtatgaattttataatgggtttctctgtgtctgcaaaaaatgtctttgagattttgatggtatcgtattgaatctctagattactttagatggtatggtcatcaaatattgtcttacaacccatgaacacagaatgtctttccagttatttaaactcttcagtttctttcagcgaagttttgtgcataccaccatgtttagatttatgcctgaatatcttattctttgatgctattataaatggaattttaaaaatgtttccatagttcattacagctatatagaaatacaactaattagcatgtgtttgtcttgcttccttcctcttttattagttctgatgggttttgggtattctttagagctttatacacataagatcatgtgtagatataattttacttctatttttcatttctaatttagatgccttttatttctttgtcttgcctaattgctctggctagaatttccagtgctatgctgaacagaattggcaaatgcaccatccttgtcctgttctagatgttaggaaaacagctttcagtgtttcaccattgagcacgatattaactgtcagttttttatatcccattgtcatgttgcagaagttcccttctgtgcttagtttattgggtatttttatcataaaagagagttgtatatcatcaatgctttttctgcatcaattgaaataatcatgtgcttattcattttactgttatagtatattacactgatcggtttataatatgttgagccacacttgcatttttgggataaatctcacttggtgatagtttacaatcctttgattatacagtagtgctgctagtattttgttagtattgctagcattttgctgagatttttgcctatattttcataagggatatcgtgctttagttctctttttttgtgctttgtctggctttggtatcaggataatgctgttatcaaaaagtgagggttgggcgcggtggctcatgcctgtaatcccagcactttgggaggctgaggcagttggatcatgaggtcagtttgagaccagcctgaccaacatggtgaaacccccgtctctactaaaaatacgaaaattagctgggtgtagtggcagggacctgtaatcccagctactcgggaggctgagacatgagaatcgcttgaacccaggaggcagaggttgcagttagccaaggtcgtgccactgcactccagcctgggggataagactctgtctccaaacaaacaaacaaacaaacaactccccgcccccaccccacaaaacaactgaattggcaagtattctttcttcatacattttgttggaagagtttgagaagaaatggtattaatttttctttaaatgttagatagactcacatttaaatgttaggtagatttatgaccaaatatggctatttggtcataaatctttttttgttaaatggtttttgattactagtccaatcttcttgcttgttatctgaatgcaggtctattcagattttctctttcttcttgagctattttggtagtttgtgtctttccagcaattcgtccatttcatccagggcacctaatttgttaatatgcagctgttcacagtattctcctataatccttttttatttctgtaaagttggtagtaatggctctactttcatttatgattttagtgatgaaagtcttccatcttttgctcagtcaatacagtgaaaggtttgatcttttcaaagaatcaacttttagctgtgtttatttcttctactgcttttcaaccttctattttattgatttatactctaatctttattatttctttccttctgctagctttggatttagttttctctggtttttctactgcttttaggtacacagtgaggttactgatttgagattttttttttaatgtgattgtttatatccatacattttcctttgaactctactttcactgcattcaataagttttggtatgctttatttttattttaatttgtctcaaaatactttataatttcacttgtgatttatcctttcactcactggtagtttaagagtacattgtttaatttccacatatttgtgaattttcccattttcattttttatttatctgttgtttcttccattgtggttgtaaattatattttgtatgatttcaaacttttaaaaatgattaggacatatttttgcagaggaagatatggcctatcctagagaaagttccatatccacttgaaaataatgtgtattctgctgttgttgggtggactgttctgtatctgtatattagatctaagcggcttatactattgttcaagtcttctgtttctcatgaagcttctgtctggtttttctacccattaattaaaatgaggtattgaagtgtccaactgttattatagaactgtgtgggtttaaccttttaatcctgttaaattttttcagctttactgaggtataattgagaaataaatgtgaacatattcaaggtttgcaatgtgatgtgtttctatctatatgcacattctgaaatgattaccaaaacgaagtcaattaacatattaattacctcacataatagctttttgtgcgcatgcgtgggataagaatacttaaccccatccccagtgactgcagagtggcccttccagctgttccaggctctggcagaggaggagcagagcgggtggcaccgccaggggagccctcaggcctggcgcgcacgcattccggaggtcgccaggccatgctccgtcgcctgggcgcccaagctgcagccccaaatttttgggtggattgtggttttggggtggatcgcggatttggggctgcacttgggcgctgcccggcaactccccagcccgctcacactgccagcatcgcagagccggggccagaagtcccggtgctgcggccaagccaggcgttctgcccggcggcggctgcacaggggcgagaactgagaacctgccgctcaaccccatcctgggtgactgcggagtgcccatgccagcggcttctgtctccctgcggcggaggagcggggcgggaggcacggcctaggggccctcaggctggtcgcgctggcgatcccgaggccgcccaggccatgcccctccagcccgcctgggcacccaagctgcagtcgccctctgtgtgcaggcagcagcctccgggaaacctctaagcccgcctgctctccgaacatctaagaaccaggaccagatgtccctgtggctgctgccgagccaggcggtccgcccgacggcggctgcacaggggcgagaacctgccgctcaatcccatccccggtggctgcggactgcttctggccagcggtcccgagctccgtcagaggaggacggcgggtggcacgaccagggatttgagggtagattgcggtttttgggtggatcgcggatttgggggtggatcgcagatttagggctgggaggcggggtggaaaggctacctggagccgcggcggctcaggagcgggttgttgagcgtctgagaagtcgccaccacgaggaagcgcttcagcttctggagacgcctgggccaggcggtcctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagccccgcagcacctggggcggggatcttggagggcgccgggcaccctcggaacagcgaagccaaacggagcctcagctgctttctatcgctggcaattccccgtctggagcacttggtggagaatttgatttatctcacaaagttaggcatatacacgtttaaaagataagtctcatatacatgatagggaggtgcctaatgagaactcattcccatatcaaaaatgccatgagtcattttcagtaggcgaaaagttctccgataaaaccctgcgtctgttttacatccgaatccacctatgtagataaattctttactggggctccttagagggaaacttggaagtgggaggtgggttccgtgttcttgaatgggaagactcagttttctcaaaatgtgagctctttctatatttatcagttttacgtaaaccaagtgaaaatatcaacgttttaacatttttgcatgacacttgctgtctgtctttttctcttgcgatgacatttaaacatttttataatggagtgaaaaaagtcttgctcctctagatatcaaaatgtgctattaattcccacaattaactgttgactaacagctgaaaagacgtaaatacatggaacaggataggaaatcccaaaacactgagataaatgtaagatatatacgtagggattgtggtaacatttcagatgagtaggaaggtatgagttattaataacgtgtcctatttgaagaaaactaataaaattttgtgcgacaaaaatgagttcctgaaagaatacagattgaaattattacatatgcaaaacgaagaaagtaccagaagaaaacagaaatgcttatttatacaggtacattttatattgacaaaggccttcctaagaatgacctcacaagtaggcattctgaaggttgatttagcaactaaaaattaaaaccccttgtgtatcagaaaaaattaacaaaagatgacatacttgaaaaatgctataattttttactatatataaatatatattaatacatattcagatgaaaagtgtgtctttattctacagggaacttattacattttttattatatataatatatattactgattataacaaattgtatatattactgatataatatgttatatatatcagttttatacacacacacacacacacacacacacacacacacacacagataaaaagcacatctttattttacagggaattctttcaaataaaatccagaagaaaagaactctaaaagtgagcaaagtacttttttgcagatccacaacttaacttacgtacataggaaaaaatccttagtgtttctcataagagaatttaagttaaaagagaaatgagactgttttctatccacaatgtttgtgagaataaagagcagtggtagttatactgctgcttaaagtttaagttgctgatgacttttcaagtagataatttggtggtaattaccacatttaaaaaatctatatgccctttacctatcaattccattatattaaaatacctttagaaaatagagatacatgcactttgttttttctcagcacttattttaacaagaaatgataggatagatcctataaataaatttcagttgcatccataggatggaataatatgtgaccattttgttatagccagtgagaaaaaaaagtcagtttgcttgcatatacacacaaacatactatggtcttgtgttagccaaaactatgtacaaaatatgataaaaattgtaacttctgagcattggtattttaagtaaagtttcttgctcctttttcttatctgtgatttccgcaatgatcatgtataaaacttctagtaaaagtttattattaatggaataatccttgggaagagagaatatgaatcttgcacaggtaaaaataatttctcgctgtctattttatcattattattgcgtgggttgttatcttctttgaacttttagcctcttcagaagtaaaaagggaatctttttatgtatgcttgcagattttattatgtatatattttattaggtacatatgcttttcttatgtatagattcattgaatatatgcaaacaatgacagattaaacatttcattttgtattcttacaaaaataataaatagcaaatataattactatcacaaaaatattgttttataaaagttttatttaaaaatattgaactccacaactgtatttatccattctttcaatccatttattcatcaaacataacatgaatgcttgttatgtaacagacatattctactatctctcaggatccttccatccttaaaaagttcatgtttacctgccctgactgagcagtttaaagaatgtatatataaattacatgtatatatatataaattaattcttttaatttaattagtttagcttagaattcagagttatttcagaagttagttgtagctaattcataatctcaaacagtattgtctggaatcttctgatccatagtcagacacgttatccatcgcaccactggcccgcggtttctcaaacagtactgtctgaaacaaattcatttacctaattatgatccctgaaattctatatatttttgtattaatataaacaagaaattagacttttaagatttttaagttagtgtgttgtatttttctctatagtcatattataacaaattggacttatgcaaatggttcttctatttaatttttataataaatggtttgtatttagtagataaatattaattacacttgattcttgaataatgtgggggttagggactcttatttctgtggaattgaaaatccgagtataacttttgacctcttccaaactagcctaccattgactggaagctttactgataacataaacagtcgaggtacatatatttggtatgtgctgctgcattatttactatgttcttaaaataaagtaagctagataaatgaagctgatataaagaaaatcatagaaaagaaaaaatatacttactattcataaagcataaatgaatcctcccaaaggtcttcatcttcatcatcttcaggtttcctgccctctgcctcttttaatctggtggacctcattctttaagtctcagctcaggcatgatctctagaaaagccatccccgaaggttttattcctattctttacaccccggtgcctaccacttagtaggaactcaataataaatatttggtaaaataaagactgtttatacaaagatgattgctacagtctagctgcaaaggggatagacatgcaaagacatgatgtacagttcaggtggtgaagtgacactagaaaaattgacaaagtactaagggagccccaaggaaggagatgcctgtgtatgtggagaaagatagtcagattcaaggaggatttcacatagcattctgagcctttttttttttctttttctgtttttggagacacattcttactctgtcacccagggtggagtgcaatggcatgattaagactcatagcaaactcaaactcctgggcttaagggagcctctcgtctcaacctcttgagtagctgggactacaggtgctcaccaccatgcctggcaaattttctgtagagtcagggtttctctgtggtctccaggctggtcttaaactcttggcctcaagcaattctccttcctgggccttccaaagtactgggattacaggtgtgagctactgtgcccagcctacattcagagtcttaaaaaatgaaaataaatttgtcagaatagtagaggaaaacatttctgatgtaaaaaatagggtgtacactaataaaggtacaaatggtaacaataattttgcaaattattagtaaataccaacttgcatagcatgttgttaaaaagatactattatgaagtagagaatagtaaagtgttactttatatgtttttactgtatttttaaattttgttttgtttccagaagttttgtttatttatgttgggtggaacaatttgtgagcaaaccttagatttttgcatggcttgaacctactgatacctagtgtctccccaagtggtgcgttgaagtttcagataactagaagtatttcttaaagatgtaaatattccagtaaacattaagctttatttaaactctcaatttataaaataagagtatatattattttgtatcaatttttataaagattatagtcgttatctaaccgttctaagtcactcattttaattaaacatgtggatttgtcagcagaacacgacttaaaagtggcttcagaggaaaagcaagaaaggcttgaaagatgtgaaaataaacagccacaggtatataaaaatttaaattttaatttctggcttactattggtttgtttgtttctttttctttaataacatggtatagtccaaatgaagtgaccttctggactatcccttttagaatccaacagataatcatttcatatttaattttaaaacattttaaccagttataaaatttaaaaaattcttacagtctgtagtaactcatagctatctttacccttggaattgaggccagaaatttccagaagtctctttgctcttttatttttataaccttcttcatgataaagaaggtaacatcaaaaattgagttgtgctactaagcaagagaaattacgaacaatttaacagtgatggccactgaattcaactcatgttaaaggactcatcattgccagtggcccaaactttgcagttttatgttgccagtcactagtggctgaggttaaagacttctgttttttggtctctggttgcctccagtgtctatgttcagggagagaattgggtcataaaatcaacccaactgcctattaagagaatcatgccttccagaatgggacctttggtattaggatacaaacaaaaactttcttattttaacataaatagtaaatgttattaaaaattttaagtccactgtcactagtggaacttagaatatattagaactggatataagcagataatctatctagatacataacactatcatattacagtatagcatttgaagtagaatctaaaaattttcttctctttctaattggtgttcattttggcttctaataatttggcatttgcctaccctacagttaatctttagaagtataaattcactgtaggggttcactatttatggtatgctgaggtaaaagtcttttaaagagagaaagcttttataatactacatatcttctgtgaacctatttctggtagatttaactcataatgaattaaatttagtcccaagaaacaacgagagttaagcttgatggttcatgtttttctcctgtgttagaccaaggcaaattagtttttacttcttagttataatccagtagcttaggggtagcaaaacatagaataagcttcacagttaaattttaattatgttataatttttctttgctcatacttgattacttcagaataaagttaattttaaaacatgcactctgacagagaaggcatctgagaaacaaaacaagcaaatgaattttccacctgcaaaaaaatgtctcgagaacaagaactgagtaagaattgtgataaagaggatatgtctattcagggcttcctttaaaattcattttaaaaacgttcaactgaagattggtgaaagttttgaaatattcaaaattactgtttgtcctgaggaagcgttcgtacatagtaactctaaagagggacaaacttaaagggagtgccctctaatctgatgaatcatatccctgatcatgaggaagcagatgcatctggagtgtctaactgtagtattccaggcattgcctgaacagaaggaatgtctgttcattcttcaaacatgtcttgtcattgcatttataccttgggttcctcaaacaaacttgccagtcatcttctaagctttattcaaatgaaaacaaatcagactataaaaattataacaaacagttataaacagaccatagcctgtttctaacagcgatgaagaaaatggttgaaatgatacagaaaatgaaaaattaaggagctcagtagttacggttgaaataaaagaaaacccagagtttgataatgcaagtgataaaaaatataaaccaaaataccactgattggaaattacacattagacattggcctcagtctagagatccaaaaagtctttttgatttgtggtttggccactccaaagaaatgtatcatgtgatacagatagaaagccacagtatttccgctgttgcagacacttataaaaatagaaaaccaatacagcacttgttccacaattcatgtggatcttagaggctcttctaaagcttaaagatgactggcaagtgtgtttcagggacctacatatgacagtcccactgttaataactataaaagcataaaacatgaattagaagttattctccaccctgtagtgacagaacatcaaaagcatatctagaagaagacttacagcaagatatccaaaggtttaagaatgaggtgggcatgttacaagtagagtccctggctttgaagaaagagaaagtttaactacaaaatgacagaggttcacttgctgttctctttttataagttatctgattcattctgattttctactcaagaaaatctcatgtgtatggttacactgtggttatctaaatgtgtaattatgtgtcaaagtaaattagtgctgctatctaaatgacacttctggaaatattcttgtaatctttgttgattactcaacccaagtctcactattagtctttcaagtggcttatgggctgggaaactaatttagccatataccatgtgatcttctgaaccagataagcataaagaaaattgctaaagaaataagctctagattcttttttctgtattcatttaaagacgaattacatttatttaaatgataaaatggtaatacagtgggagggaagcaatgactgagaagagacataaaaatatatcttgccttgagagttgcaacaaatattcccatccaaagaagtctgtttaatgtgctttcatgcatgcaagtttatctgtttgactcaaactgtttaaacttattattccatcatggtcattttaaatatttttggaaacaaatacatatactttcacatattaaaaaaaatcaccactctccaatgtttctgttgaatcagaatttacgttatgttgtttattaaaatatgttaagttttgacatgtatgattttgtcatataagtagcataacccctcagccaaaaatttagcatttgattctttagttgaaagctgagttctgtacattttgttctaaagatagacaaaaatctagagattttcttttttcaaagtaaaagcagatgaggcctcccactaccctcggaggcatgatctaggagacagcagaaagcagtttcaattctagtcatatttctagctctagctctacatgcaagtacctctgagaagtattttcattggcctatacacaatgaggatactgatacatgtatattataaaataaaaatgtgaaatacagatgtagctaacattttacaactgaagcattcttctagtcactggtaaatgaaaacaccttaactaaatcatatggcaactacatgtgtgaagcttactaaataaattgtttcataaggcattttttatagagaagtatttattctccccagtcattccctgcttactccactttctattgggctttttgcatgtcaaatttgaaaacatgaacaaacaaaataaagtgaacatggtagtttattattatgaaagtaattgtaatgtataagttagatgtccctgtgctattgacaaaattctctaaaaaccttttgaataaatgtgacaaagactacctaagttgatgtccacaatttgagagaaaagaaagacaaaaacagtccttgaggactcagatgcctcaggaagatttaagaagtttttatactttgatggagcttttaagaaaaattcatctatttttttccttgctctggtcacatactgagaggacttacagactgcttacttaatagtatggatttgtatttttcttagagtaaagtagcatcctgattttgaaatagttcctgtagtttgtttaaagaaagcaggaaagaaacaaaacaagaaaaaaaggaaagaaggaagaaaaaaagaaagtgaggaaggaagaagggaaggaagaaaaaatatggaagaaaggaagaatttcttttagagtagtggaaagctgtcaaaatctgcttaagaaaaccgtttgtataaaatgttttgtcttgccctccaaagctcaaagtctctggtcctgctgatggctttcctatctagaatatacagatcttccacaaattgaaaaactaaaatatagaaatatattttgtacaggtggcggatttgaaatgttttatcaaggctaaaacaggatgtatatcattataatacttttccttcacattctgctctgaatttgctcagtcagcaccattccacttaataaggcttagatcaaatcaaatcaaactttgatttgaatattacagaagagaacacatggtaggagcttgtatattctctgtctctcttactctctctcatgtctgagagagaataccttggggttgaccagctagacagtttatgagaaggtagtatctccctgttttcattctccaggaatactgaacagtgtattattgaattatatttgattaaaatatactgatggaaaagagcacttcagagtgtccaaaatggaagtaaatgtaaatctttttataatttataaataccaagtttataaaacgaatcttctcttgtagatttgtagattgtagatttctgctcatagcagaaagcagaggccaagataattttaaattatcttacttttaaaaatataattattttctaaagtgaacttaaagcaaaatctaaatacagaaaaatgcctgattacaagggtgcagctcaaagagcttttacagagttaggcacctgtgaaagcagcacagattaagaaacagcactgagcctccccacccaactcatcgccgtgtctctccatagctacatcctaacttctaattagatttctagattggatttctcaggctttgagtttctcacaagtggggtgatacagtaagttttcttttgtgccttctttttacaaatgattttttgtgaaattcattcatgttgttatgaatagttacaggtcattcattttcatagctttattgcagtccatgtgaatatagatactttgtttatccattttcctatttacagacctttgaggagtttctggagtagggttgatgctaattgtgctgcaataataatatttaacattttttggaaacatgtacacatttttagggcatatttctcagaatggaattgctgggtcatagaacatgtaaagtagatattgccagcagtttttcaaatttatatttttcaaatttatacaagtacttctagtatatgtgaattcaagtcactccacttccaaaccaacacattgtatgtttttaaaaaatatttacatttggatgagtttgtagaaatattatatttaattttgcattttttgtgtgtaatgaagttgagcatctgtttgtgtttatgctggctgtttgaatatcccatcttataaagtgccttttaaaatattttttctatatttctacttgattgcctatcatttattgaatactatagatatgtagaatatacacataaaatatctccttatatctttggccttcatttttattatgctaatagtgcctgtggattcacagaatttctccctttatttgtttgcttttgagacagggtctcactttgttactgaggctggagtacagtggcacgatctaggcttactgcaacctctgcctcccaggttcaagcagttcttgtgcctcagcctccctagtagttgggattacaggcatgtgccactaagctcagctgatttttttgtatttttagtggggacgagtttttgctatattagcaaggctggtctcgaactccttgcctcaagcaatccacctgtctcagcctcccaaagtgctgctgcgatttcagatgtgagccaccatgcaaggccagaatttcttaatttgacataacaattttgttctgttactgttaggtttgttttctaacaccctgtttaagaactatttatcccagggggaataaagttacttatcaaatttgttctgttacttatcaaatttgttctgttactgttaggtttgttttctaacatcctgtttaagaactgtttctcccagggggaataaaattatatttacttatgtaagtgttaactacatgtctcaactgtggggaaaatggattcctagataactctttgtagtactacatccattgtttgaagtgtagtgtgcataaaatttaatgaagacaatttgcattgaaaaagtcacatttctataaagccataaattaattagttctaagacttagcctacttggatgttagtaagttcagtctcagttgcttacattgtgttctcataccctgcatagaaatgatccaaatatgaataggaatttgaggtataagtgttagcagaaaaagaaaatcaggggtgctccatggcttctgtccacagtgggcactgggttggcctttgccttacctaggagatggggtggtggagtgctcaggccagttgtctgcccttgggtgctgctgtcaggaatgagactctcatctcctttcttgaagacatcagtctctgctaccttgctcctagtctcctcctcaagctcaggaaagactaaaaatccctcagatctagttggtttccacctgtaccagtctttcacatctctgtgctttgagataaagcagtaccagctctttcagtgagagttaagacactggttaaatagagtttgatcttcctgcacagtgatagcaggcattaaagatggtaacacaagttaacctttttctaaataatatcaacaactataaaagaaaattcaaaatatgaaaatattctaaaattgtatttaggataaaagtaactatggtacttggatattcactaataaatattcaggatctaaagtttattaatgctttcaaaaaaatagtacctatttttaatttttactttttttgtttttagagattgtggtctcactctgtcaaccaggtgttggagtgcagtgggacaatcatgggttactgtaccctggaactatggagctcaagtgatcctcttgcctcagcctcttgagtagctgggactacaggtgcatgctaccccaactggctcatttaaattttttttttttgtaaatattggatctggctgtgtcatctaggttggtcataaactcctagcctcaagcaattctcgtaccttggcttcccaaagcactggtattacagatgtgaacaccatgcatggccaagaaacagaatgtaatattataaagctatcaactgaagaaaatatatttgatacatatgtaaaatgtaaaacctaaaatctgattttttctcctcttcctcaccacgtgtattattccattctcacattatgataaaggactaactgatactgggtaatttgttaaaaaaagtgggggttagttgactgacagttctcagactatgcaggaagcatggctagagaggcctcaggaaacttataatcatggcagaaagtgaaggggaagcaaacacatctttcgttgtgagagcaagaggaagagagagaagggggagatgatatacacattttaaaagccagatctcatgagaattcactatcaggagaatagcaagggagaaatctgcccccatgatccaatctcctttcatcagcccctcctccaacactggggattacaatttgacatgagacttgggtagggacacagactcaaaccatatcattctgtcctggcccctcccaaatctcatgtccttctcacatttcaaaatacaatcatgtcttcccaacagtcctccaaaatcttaactcatttcagccttaatgcaaaagtccaaagttcaaagtcttatctgagataaggctagtcctttttgcctgagcctgtaaaatcaaatcgatattacttattacttacttccagcatacaatgggggtacagtcattgggtaaatgctcccatttcagaaaagagaaattggccaaaacaaagaagctacaggctccatgcaagtctaaaacccagcaggacagtcattaaatcttaaagctccaaagtaatctcttttgattccatgtttcacatccagggcatgctgatgcaaggagtggtttcccaagtccttgggcagctctgcctctgtggatctgcaggatacatggctgcttttacaggctgatattgagtacctgtggcttttccaggcacacaatacaagctgatggtgaatctactattctggggactggaggactgtggcctttttctcacagctccactaggcagttcccctgtgggaactctgtggggggcaccaacccacgttttccctctacactgccatagcaaacattctccataagggctctgcccctgcagcagacttctgcctggacatccaggcatttccatacatcctctggaatctaggctgatattcctagatgctcagcctccgagcatctgcaggcttaacaccacatagaagccctagtggcttccagcttacaccctctggcacagcagcctgaaacatatctgggacctttttagccttagctgaagctggatgcagggagcagtgtcctgagattgcacagggcagcacagccctgggcttagcccatgaaaccattcttttcttctcagtctccaggcctgtaatgggagggatggcaacaaagttctctgaaattccttcaaggcaattttcctattgtcttggctattaacatttggttcctctttatttatgcaaatttctgtagctggcttgaattcttcatcagaagatatgtttttcttttttaaaaaatttattattattatactttaagttttagggtacatgtgcacattgtgcaggttagttacatatgcatacatgtgccatgctgctgcgctgcacccactaactcgtcatctagtattaggtatatctcccaatgctatccctcccccctccccccaccccacaacagtccctggagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccagtttttcatggggttttttttctcttgtaaatttgttggagttcattgtagattctggatattagccctttgtcagaggagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtgcttgcccatgcctatgtcctgaatggtagtgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaatagggaatcctttcccctttgcttgtttttctcaggtttgtcaaagatcagatagttgtagatatgtggcattatttctgagggctctgttctgttccattgttctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattcatgatattgattcttcctacccatgagcatggaatgttcttccatttgtttgtatcctcttttatttccttgagcagtggtttgtagttctccctgaagaggtccttcacatcccttgtaaattggattcctaggtattttattctctttgaagcaattgtgaatgggacttcactcatgatttggctctctgtctgtctgttgttggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgatttcctcttttcctaattgaataccctttatttctttttcctgcctaattgccctggccagaacttccaacactatgttgaataggagtgatgagagagggcatccctgtcttgtgccagttttcaaagggaatgcttaaagcttttgcccattcagtatgatattggctgtgggtttgtcatagatagctcttattattttgagatacgtcccatcaatacctaatttattgagagtttttagcatgaaggattgttgaattttgtcaaaggccttttctgcatctattgagataatcatgtggtttttgtctttggttctctttatatggtggattacatttattcatttgcgtatattgaaccagccttgcatcccagggatgaagcctacttgatcatggtggataagctttttgatgtgctgctggattcggtttgccagtattttactgaggatttttgcatcaatgttcatcaaggatattggtctaaaattctcttttttggttgtgtctctgcccagctttggtatcaggatgatgctggcctcatataatgagttagggaggattccttctttatctattgattggaatagtttcagaaggaatggtaccagttcctccttgtacctctggtagaatttggctgtgaatccatctggtcttggactctttttggttggtaagctattaattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctcttttttctttattagtcttgctagcggtctatcagttttgttgatccttttcaaaaaccagctcctggattcattaattttttgaagggttttttgtatctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccttctacacactgctttgagtgcgtcccagagattctggtatgttgtgtctttgttctcgttggtttcaaagaacatctttatttctgccttcatttcgttatgtacccagtagtcattcaggagcaggttgttcagtttccatgtagttgagcggtttagagtgagattcttaatcctgagttctagtttgattgcactgtggtctgagagatagtttgttataatctctgttcttttacatttgctgaggagagttttacttccaagtatgtggtcagttttggaataggtgtggtgtggtgctgaaaaaaatgtatattctgttgatttggggtggagagttctgtagatgtctattaggtccgcttgttgcagagctgagttcaattcctgggtatccttgttaactttctgtctcattgatctgtctaatgttgacagtggggtgttaaagtctcccattattaatgtgtgggagtctaagtctctttgtaggtcactcaggacttgctttatggatctgggtgctcctgtattgggtgcatatatattcaggatagttagctcttcttgttgaattgatccctttaccattatgtgatggccttctttgtctcttttgatctttgttggtttaaaatctgttttatcagagactaggattgcaacccctgcctttttttattttccatttgcttggtagatcttcctccatccttttattttgagcctatgtgtctctgcacgtgagatgggtttcctgaatacagcacactgatgggtcttgactctttatccaattttccagtctgtgtcttttaattggaccatttagtccatttacatttaaagttaatattgttatgtgtgaatttgatcctgtcattatgatgttagctggttattttgctcgttagttcatgcagtttcttcctagtcccaatggtctttacatttttgcatgattttgcagtggctggtatcggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttcttcaagaatgttgaatattggccgccactctcttctggcttgtagagtttctgccgagagatccgctgttagtctgatgggcttccctttgtgggtaacccgacctttctctctggctgcccttaacattttttcctcatttcaactttggtgaatctgaaaattatgtgtcttggcattgctcttctcgaggagtatctttgtggcgttctctgtatttcctgaatgtgaatgttggccttccttgctagattggggaagttctcctggataatatcctgcagtgttttccaacttggttccattctccctttcacttttaggtacaccaatcagacgtagatttggtcttttcacatagtcccatatttcttggaggctttgttcatttctttttattcttttttctctaaacttcccttctcgcttcatttctttcatttcatcttccatcactgataccctttcttccagttgatcgcatcgactcctgaggcttcttcattcttcatgtagttctcgagccttggctttcagctccatcagctcctttaagcacttctctgtattggttattctagttatacattcgtctaaatttttgcaaagttttcaacttctttgcctttggtttgaatttcctcctgtagctcagagtagtttgatcgtctgaagccttcttctctgaactcgtcaaagtcattctctgtccagctttattccattgctggtgaggagctgcattcctttggaggaggagagatgctctgcttttcagagtttccagttcttctgctctgttttttccccatctttgtggttttatctacttttggtctttgatgatggtgatgtatagatgggtttttggtgtggatgtcctttctgtttgttagttttccttctaacagacaggaccctcagctgcaagtctgttggagtacccggccgtgtgaggtgtcagtctgcccctgctggggggtgcctcccagttaggctgcttgggggtcaggggtcaggaacccatttgaggaggcagtctgcccattctcagatctccagctgcatgctgggagaaccactgctctcttcaaagctgtcagacagggacatttaagtctgcggaggttactgctgtcttcttgtttgtctgtgccctgcccccataggtggagcctacagaggcaggcaggcctccttgagctgtggtgggctccacccagttcgagcttcccggctgctttgtttacctaagcaagcctgggcaatggtgggtgcccctcccccagcctcactgccaccttgcagtttgatctcagactgctgtgctagcaatcagtgagactccgtgggcgtaggatcctccaagccaggtgcgggatataatctcctggtgtgccgttttttaagcccgtcggaaaagcgcagtgttcaagtgggagtgatccgattttccaggtgccatctgtcacccctttctttgactaggaaagggaactccctgaccccttgcgcttcccgagtgaggcaatgcctcgccctgcttcagcttgcgcatggtgtgcgcacccactgacctgcacccactgtctggcactccctagtgagatgaacccgatacctcagacggaaatgcagaaatcacctgtcttctgcattgctcacgctgggagctgtagaccagagctgttcctattcggccatcttcacataagatcatgtttttcttttataccacatggtcaggctgcaaattttccaatcttttatgctctgcttcccttttaaatataatttccaattttagataatttatttacttaggcatattaccgtaggctattagaatcagccaggtcatatcttgaacattttgctgcttagaaatttcttctgccagataccctaaatcattcttttcaagctcaaaattccacagatccctagaccagggcacattgctgccagtctctttgccaaagcatagctgagtgtccttttccccagtttccaatgagtttctcatctccatctgagacttccttagcctggactttattgtccatatcactattagcattttggtcacaacaatttagcaagtcacgaggaagttccaaactttccctcaccctcctgtcttcttctgagccctccaaactttttcaaattcttcccattacccagttccaagtcatttccaaattttcaggtatctggtttttttaatttttcaaaaattcagtttattgagagaagacatatatggtaaaatgcacccatttgaagtgtagagttcagtgagttttgacaaacataacctcaagccacaatgaaaatacagaatattctcatcatgcccagaaagttcccttgtaccccttggtagagagtctttccctccacacccaaccccaggcaaccacagatttgctttccgtccctatggattcgttagcttctagaattggaaataaatgaaatcgtatggcacatacttcattgtgtttggtctcttttcctgttttttgagatccacagacactgctgtgtgtattaatagtcattcatttttactgctgtgtggcattccactgttacaaacataccaaatatccatttcattcttgatggatgtcaggattattttcagtttattgatattataaataaagtagtaacagtctttgcatggacataggtttttgcttatcttggggaaataagagtcgaattgtttggtcacatggaagtgttcatctgcctttataagaatctgccaaactgttttccaaaatgattgtaccattttacattcctttttttttttttggcagggtctcattctgtcccccacactggagtgcaggggtctgatccctgcccaccgcagcctccgcctcccaggttcaagtgatcctcccaggttccagcgattgtcctgccttagtcccctgagcagctgggaccacaggcattcactaccatgtctggctgacctttccatttgtagcagagatgtgtttcgccgtgccggccaggctggcctcaaactcctaaccttaagtgatccacctgcctcgaccccgcaaattgctgggaccacaggcgtgagccactgcaccctgccccattttacattcctatcaacatgtgagcgtttcaactgctctgtatccttatcaacaatgaagactgtctcttttttattttaaccattccagcaagtatgttcagatagctcattatgggtgaatttgcatgttcctgatgaataattataccctgtgtgtgcttaatgcccacccatataccttctgtgagatgcgtgtttaaatctttcacccattgttttactgggttgcttgttttcttattattgagttctaagagttctttatatgctcgatacaagtcctttgtcctatatatgtattgtaagtattttcagagggtgtggcttgcctttttattttcttaactgtctttcaaagaaagagagtcttaaattttgatgagatcccacttatcaactttttcttttgtggcttgtgctttttgtgtcccaagaaatttttgcaaatgttcactgtttttcctgtgactactctgttgccagagccacctgcagataagacaattcctccaccttgaattatcccggtacctctgttgaaaatcaattaaccaaaagtgtgtgggttgctttctgggctccattccaccccaatggcctgcgtgccagtcctcttaccagcaccacattctcatcgctgtagctgcacacagtcttaatattggggtgagtaacttacactgttttggctactcttactcatttgtatttccatatcggttttagattcggcttctcaatttctacaaaaaaattctgctataattacaatagattgcactgaaattatcaattagtttggggagaactgatgtaacactccacgagcaaagtctacatctgtttttatttaggtcttattatttcaatgtgcatgtcctacaaatattttcttaaatttattcctccatatttcaagtttttatatgctactgaaattcctaatgaaattgaatttttaaaatttcattttccaattgtttactgctaatacacagaaatacaattggtctttgtatactgaccttgaattcttcaaacttgctaactttacttattagttctagtggcttctctgtgggttccttaggatgttttatggacactctaatgttgtcttctctatggttcccttgcttcacctcaattcctggcccacctcaattcccagtgaccctgatacccattgtaaggcagggaggcagctgctttctgtcatctgtgctgcagtagtttgggaaatgccctcagttgaaaagcagaaaacgtaaaaatgtcacgtggttcccccctgtctttcaggggtagatttatctttggtctctgcttacccttttgccaggctttctgggatcgccactgtgaacgtgtagtttagtggtcggcctgggatttgggcagttcctactcagattcgggcctcacctcttggtagttttctcgcttctgggattttcgtattaaatttccagtattcttcaagttccagactatctcctctaccatcttaggagagtaaagcctatgtctcacaccactctagtgtggagattatgaaaaacccttaggcaagagagccacaggctcccagttcaaacccactgcagctgctgctttataggagcaaactctcctccagctctggcctgcttttggacactctgaggtccctttaaataattttctgggccgggggcggtggttcacgcctgcaatcccagcacctcgggaggccaaggcgggcggatcacgagttcaggagatcgagaccatcctggccaacacggcgaaaccctgtctccactaaaaatacaaaaaattagccgggcgtgttggcgggcacctgcagccccagccactcgggaggctgaggcaggagaatggcgtgaacccgggaggcggagcctgcagcaagccgagatggtgccactgcactccagcctgggcaacagagtgactccgtgtcaaaaaaataataataatgattttctgtccaaattttatatttatctatgggacagtttgtgcaaccatggttaccagaagttaccagaagttttggctaaagccttctaaatatcttgtttctttctcctttgcgggagtgtagcttgcttcttgagtgactgcagcgagcagctgcttgcgtgcactggctgcctagtgcagccaccctgcttcacctttaagagcaggtctgtgggctccagataccagctggcaaccgcatggcctgcttcatggtatgccacggtcttctcctcaggctgcagaacctgcgttttcttctctaagcgaccaatcacttgctcaattgcctgttcgaagtgtttctgatttatggaatctgacaggtgtctcgcagcaatctacgcagcttcattacagacattagcaacatcagcacctgaaaaccctggagttaaagatgccagttttcttgccaatttctccttctccagggtactgtccagttttagtggtcggaggtgaactttgaaaatagaaccccttccttttatgtctggtagtccaataaagatttgcctgtcgaaacgccccggcctaagcagcgcagggtccaggatatccggttgattggtgctggccaaaatgacgacatttgttgttgtattaaaaccatccatctccaccagcagctggttgagtgtgtcctcctgctcattctgccctccaaagttgccttttcctgtcttccttcccaccacattggaagaggatgcaaggggcattcttccgagcaagggcaaataagtctccgactctagctgggcccacaccaacaaacatctccagaaactcggatccactaacggtgatgaaagggacattggcttttccagctgtggccttagctagcagcgtcttcccagtgcctggagggccagtgagaatggcaccctttgggatttttgctcctaggtcttgatactgctttgggtttttcaagaaattcacaaatttcatgatctctagcttggccttctcacagccacatctttgaactgcacatcaatttcatcctttaagaccttggtttctctgacactaaagagttggcccatccctcggcctgtccggccaatgccagcaggccctcttctgatggtgcagagcaagaaggcaatgatgagcaccgcgggcagcatgctcagcaggaaagagtcatcactttcagcaatgtagacaacaggcacccgattttctccttctatgcccaattcctgctgtaaagtttccagattccattcaaaggtgtccacactgccagtattaaaccaaacgtgttgcccatcaacaggagttcttcctggtgtaaaggtcactcgaacaaaacgctcgttgacaactttcagtctgtctactactccttttgaaacatagttattgacaagttccttccaagtgacttctctcccggatctcttgagcaggaagtaaaacatgactctaccccagaatagagcagtccagacgaagaacatcctgaaatccttgtcgtcccatggaaagtcacccttctggaacctggaccaccagtgagaatcatctttcttgccacctcgttttccaccgccaccacctcctccttcagaagagtgtgtggtagcagctggctttgattcttttttctgtcccataacttctttaggttcattagcatttttcccccatttttttccattaggaaagtatttttcaaatccttttgggggtcgagaacagaatatttgataagcagcaattacatctgtcaaaagagaatttctgctggcccttgcttgagttgtaataaatccataaagcgtccgaaggcagggctgctcgccagggcccatgcctgccatgcacgaagagctgctttaggccgcggggcccagcagccgacccggccccacagctgcaagcagcagcgagccatggccaccgcagtggccctcttggcccgggacgctgcgcaggcgcaagcaggcgacaacgggctgcctcgggaagcgggctccactccgggagaggctgccaggcagcgaagtgcgcccgtggctcactgcagagcgcaagctctcaaccaggtatctttatagtaatattccacttctctggtaccaattttctatatttgtctgttcttatattgctataaagaactacctaagactgggtaatttataaagaaaaaaggtttaattgactcacagttctgcaggctgtacaggaagcatgactggggagccctcaggaaacttacattcactggggaaagtgaaggagaagcaaacacatcttacatggcgggatcagaagaaagagtgagaagaaggaggggacacacacttttaaacaactagaagatattgtgagaactcactcattatcatgagaacagcaagtggggaaatgtgcccccttgatcccaccatgcccctcttccaacactgggggttacaattcaacacgagatttgggcagggacacagaccctaatcatatcatcatggatatcacctttgagaaaaacaaaggttaatcaaaaaacaattcttatcagagtatttttatttgtgttttaaatagttgtcagacaaatcttcagttagaaatcaggccaattttgacttttggtttttttctaagtttaactcctataagtatgtattaaattaaaaatatccagacatcttcaaaattgcgtgatggaaagaagtgatgcctgagtggttcactcttcattttatggccagattgaagttaaggttgtgagttatcaatgactatgatcttccttaggagaaaaaaaaatgtggcttgagtgaagcctctaatctcagtaggctaatagcctccatcactctgttcttgggtgactcatggcttcaaatccctgagttcttgcttgaaaaactttgggtttcccttctgcccacccatggctcaaatcattttatctcccctctctgacacctccttcaatgactaattttagaaaatatatttagcttattttaaacaaaatcttatttttattgaattggaactctgaacttaatttgataaattgaacttaatagggcatataaataggatatctaatataaatgaaaattcaacaaatatgcagagaggtgattcattatttgaaaaaaaaaactgcttccagcatgagaagggtaaagccatgatattctttaacttgtctgtttctttaactcatttatcacgtccaaaaacagaaaaagggtttttttctattacagttaatattgtgtttatcaataaagaattcaaaataaatatcctacatgctttggatgtcttctaggcaatcactaattgcagctaacacagaaaagatgtcatgtgttttggtgacattgttgtatttgataaaagatttttcttcattttctgcagctcctaagcccatgaccgttctgtctccttaccctagttcctcattatgacaggcagaacaagtaggacactgtgcagggaatggaaaggacactgggtggttgtaaaaggttgtctccactcccctctgtgtttgaaaaaactgaacattaagtgctgcatttaaatgcacacacacagttatactgtttgaaacaggttaaaaatgtggtgtgctttgtgatgacttcctccagagtttctcagaagtacattaatatgccaatgtactctcatttttctatgtataccaattataagataaagtgttaaaataattctgaaaaatgtaactgtaatcaattagaataattagaataaaagaccctggtgaccccatccttctgaaaacttcaaaatctgtagaaaatatacaaaaaatacacccagttttagcaaaaattactaaatcctcatagaaatttccattgatcttggacttccaagcctgtagaactgctcagagatactttcttttcttctcttccttttaaagagcttcatggtgtgagtggagtgtctgaggagtagcacctcccagcttctgcctgggcactcacctgagctgaggtgctcacttgagcagaggtgcagcttcggccaccatgggaaaaccagccctccctgggaagcacctctctcccagccttgcctagtgggggcctgggccatcctgcagggcaggtgctgctgcctcccctgcaggtctgcagctctgtattcagggctcacggctggaagcggagcctttatgctatgccctgggtggcacgggagggcaaacaggctccagggctgtgcacaacagcgcagctaggtggtccctgcctggtttcctggcctctgtaaacagaccccagaggggaccctcctcagcctcagtcacacctctgagaaatgctggggactggcatctctgccgagaggaccaggttgtctaccaaaggcccagctagcccatccctccctgcacagcaggcttatgcctggcctggaggcctggcacatacagcagcaaagggcaaacagagcagccggtaggatcgccagcaaaggcaagggtagacccagtggcagaagcctccttggtcagcggcaggcaaggttctccctcccttccctagagtggccagctgccctcacagaactagacctcccttaatcatccccccagggtggcggctgcctggggacccggtccccagcaagggcccctgatcttggctgccttcctctcgctgctgcacagagcctgcatcctcctcctcctcggatcctccttaccctcctcctctacctcctcctcctccttgtgctcctccttcttctcctcaccctcctcctcctcattctcatttccttcttgccctccccctcctcctcttcctctcactcctcctccttctgatcttctcctcctccccctccccctcctcctcctgctcctcctcccctcctcctcctccctcatcctcctccctcttcctcctcccccttcccttcctccgtctcctcttcctccccctcctcctccttcccccgtccctcctcctgcttcccctctctctcctcctcccactccttctcctgcttcccctcctcctcctccacttttccttgccctcctcgtccttgttcttgcatttgctcttctccttcacagcctttccttcctctttgcctttttcttgggctggtccttggagggaatttgcctttctaatcttccttgctgctctccttggggtctgcctcctccagccccagccttgaggtctgagcagcttctgtctgaaggccaggaggtaggactgggttgcaggggctgctgggcagggccctcttcctcctatcacatcagagatgttgtctggcacgggaaacatccaccctccgctgtgtgtcccacgcttctctctcaaagttgggttcattcatgaagaaggacagcatttagcagcggtgggcccctcagggtcgctgacaaagatgcctgctccttcttccctcctcgggtctgagagaggggccctcggcaggggcctgggcctgccccgcttctgagagcgcctgggagcccaggtgcagccctggtgggagcttcccgctcctcggcctctaggcctttgtggaggacatgtggtctctggctctgcccactgctgggtagcccggacagcgccttttgagggacctgccacctcccctgttcgtcctccctggaaagagtgatgttttgactggggttggggaccgagggtggcaggggcttcctgtggtgctgggctctgaggcccatgtcgtcctggagaactgccagggtttctgggggtgtggctctcgcccagggcctccccagattgtggctgttccgctgtggccttggcttccactatctttgtgtccctgggggtgggtgtgtggccgtttctgccaggaatatggagtccaggtgggtgctgggaaccaagtcctccacattctggacttttgctgaggcttctgcagccggggccagctctggaggtgaaggggctgcattggccgcgtgatgtcccagacagcctggaggtgacgctgcgcggtggggcggggtgaccagacgggccccagcggcatgtgggagccggcagggtctccgaccctgggatgttgaggacgaagaggacggtggcggacgggggacaggctgatggggcattgaggggccgctgtgggggcgggcggggtgagggggtctggagctccgggtggacactgcgctcagaagcgtcactggctcctgggaggccaaggaccggctttgcctgttggccgccagcggggacgcggagctgcggctgggagcccccacgtggaggaaagtgcaatgcttctggtcctcagtctcctgctgcaccaccgctcctccagcgtggagtccacctccaactgctttttctccctctgaagctgcaaaaatggaatattgaaaaattcgtgaaggtgctttaggcccgagctgttcttcctggaagactcggcggaggggaacaggaggagcggcctcagcaggatgactcccactggctcctgtcccgcagtccccaggacgcacacctgcgcgtgggcagcactttctgaagccccagagaatgcacttgaaggcgcactgcttggtgatggggatcacctggccagccggtggcagttcttgggcacgtccaggaacttgcatccaggtccattttggactccgcctccttgggttgttctccacctgcaagccccggtctggctgtttgcattttccaccctccactacctccgagacttcaactctcacgacgtcttcagtggtggggtggttcccgtagatgctgtggcctggatccctgcgtggggatatccacctccaccaaatgcttgccctgcggaccgtgcctcagcgcggtggggcgggtggccccgtctcccggatagccatcttcatgttttcacgccacggcgaagcgcctccgtggcctcagctcctggcctgcagcacgcaggggatgttcttgtccccgccggggcctgctccgaccccaccagcttcttcagggcgggaaccatctttctactgggacgtccgagcccggtggcggccgggaagctcagcggcagcggcggagcagctcgactcgcactgtgtccccgcgggacaggcctcccgctaggcccgggacccacggcgccacgcggcctccagccagggctcccgacctcagcgcagctccgccatgtcctgcggcctccggagccgccgcctccagccctcggcgccgccacctgggagccggctgcgcagggcgccagcgaaaatcgcatttctgcttagaagccacccagttcacggtgttgtgttatggcggcctgaacggactgaagcacatagtgactatgtctgtgctcgcttttaaatttacttttatctttttaaaatttttattagttttcccggaaatcttgatgttttacatagcctcaaattccttcttggcaaagttatacttgctaaatatttagtagtttcagcaactgtctgaaaagacacaattatgctgctaaaaaaacaaggaagaaagaagagacagcaacagacagagtttgagaatttgaattttctatacacacagattaaattttgcaaataatgtttctcttcttttctgttgaagtaaaaacacccaaactttcctgtatatatttgtacaactgaaatcccccctggactgtcacccttgccctaactaaaaaatcagttatattctagaaaatgagaaagaaaatataatgaagataaaaacatgtattaaacatggttatctgaacggactgaagcacatagtgactatgtctgtgctcacttttaaatttacttttatctttttaaaatttttattcgttttccccggaatcttgatgttttacatagcctcaaattccttcttggcaaagttatacttgctaaatatttagtagtttcagcaattgtctgaaaagacacaattatgctgctaaaaaaacaatgaagaaagaagagacagagcaagagacagagtttgagaatttgaattttctatacacatagattaaattttccaaataatgtttctcttcttcttttctgttgaagtaaaaacactcaaactttcctgtatatatttgtacaactgaaatcccccctagactgtcacccttgccctaactaaaaaatcagctatattctagaaaatgagaaagaaaatataatgaagataaaaacatgtattaaacaaaaatgcagtgataaaatcgtgagtttcaaaataccctgtgagctttgtttgttaagtccagggaaagagtaacaaagataggcattaggtgtgcaggtcatttacatgtgtttatgtggccatgtctaccattttctctttaacttttcataacgtggaactcatttctttaggtagaagttatgagttaactatcttggtagtgtttaaagaacaagcattctttaaaagtccattctttttcttcatttttgaatatgcatagcattacagaaaaattggaaagtaaaccagaaaaatacccataatctcaccattccaatacaatgctgtctgtgctttttcaaaaaaaagggacctcaatttctaaacttagagaaaaatctctagcttttgaatttttttatattctgaatttttgatgaagagttatgaatttttgatgaagaagtatttgtttactgcctctagcattgtattttaaaagagaccggtcaaaatttgattttaaaacaaaggattaagaactcttccatttgtgcttattttacatctatcaggtgagagtaaaatcactgatttaaagacctctgagttttcacaacacaaggaaaaataaatagacaccacccttactgttttgtacattccactgaaatataagttccttgtggacaggggttttcatctgttttatttgctgctgtatcccagtacctggcacctagtgccacgtaggaagtactcaagtacttgttgactgagctaattaaaatagtttcaccatagcagaattgcctttattctgtgggggcgacccatgtaagtttatcttttatgtcaaaaatgccattttaatgcatttatgaacatcttcaaattgcatcataggttttgttaatttttttaactagagtacttcagacatattttgcctgctgactcaatggtgtcattatgaatattactataatttttaggtgggccagtgaagcttgtgttaattaccatgaactgttgttttgatgacttggaatagattaggatgaatgttgtaaaggtttttctatttctgctggaatcttctgtcattctactcatcatcatctaggtaatggtctaaggctggcaccatttctcttatcaagtaacgcaaatggactttttggcagatagttgttgtttaacaacttttgtttttagtttcagagactatgttctggaatgttgagatttcttcatacatgacctctagagaaataggcatattataaaatgagttacactgtgtaactgagggcatgtgctgatggcaaaattattatcttcaagaattttttttttagtgttctgcatttgcccacactgttagaaatggaatgttagagaatatttattattttgttgctatcaaagcaaaatttgcagaaacttgaatttattgtaattactgtattaactctgaaatgcatggctatgttttaagggaggtttttgccttccatattgttctcgttctactttttcttttactcagaaggacttaatctctaaacattagaaaatgttttatacagagacaggtctcactgactacaattagaattataagaatctcttcatttgtattagttgataaaagtattttttcctgtttttagataacagtcctccaaaatttatattactattatcaattcacttcttaagataagcacaatgaagtagtgcctctgggtgttaggattatgtagttttaacatttacattgattatctgtattttctactaaaaaaaaaagcctatacgatttaatcaatatgttaccaatagataacaaaagtatagaatactgtttctgctcctttaatagcgagactttactctaatttcatggtggttctaaggtagtagtaagatgcaaaaaagaggtgcagatgtgacaagaaaagtgagcaaaaagtaataatgaacccacttaagaaattacatgtctgtataagtattaaagataaagcttaggcagggcgtggtggctcaggcctgtaatcccagcactttgggaggccaaggagagtggatcactcgaggtcaggagttcaagaccagcctggcgccaacatggtgaaaccccgtgttgaataaaaatacaaaaattagccaggaatggtggggcgcgcctgtaatcccagctacttgggaggctgaggcaggagaatcacttgaacccgggaggtggaggttgcagtgagccgagagctccccattgcactccagcctgggcgacaagagggaaactatgtctcaaaataaataaatacataaataagaagaaataaaaaggttaaggatctgacacagaaatgcacacattttcttctcaactatcaaaagcaggaggaaaatttttaaacttcccagagatgagttttctaagttttattttccaaacttcactcttattaacctttaaaacaacactggtagatcatttctgaagtgaagttttaaaatattcccttcactgtctgaaagcaaaatataacccttagttttatcaatttgtaatttttagttaaagaaacaacttgataatggggactaagggaaataaagtttctctgcgggagtccctgctgaatgccgccctgagctagcgggcgacgctgcgcttccccgctggagggcgccatcatcccatccacagagagctcagcaggccacgtgccgcggcctgctgcgaacccgcagggactgctccctggctggcggcacccttattgttcaataaagacctggttcagagacaaaggtggccctgtcagtagctctgaatagccccaagctagttgctgatcctaacaggcccaattaactgctactcatttagcaaagcggcccgggacccatcccgcttcccgctccaccttctgaaactctccctgcctgggtaccttggctatgggctttgcagtctccctttagcggatcaaaggtgtgtgggaaagaatgacggctggatccgcctccacaggtccttacacagacgcacacatcacagccagacccaaagcactcatggtggtgagcgagagcccgaggtggaattccagggccggtctcagaacaacgccttgattgccgtgattcgaagagctatctcaaaacatttcgcttcagtgaagtgcctgagaagaaacactcgtcacaactcactctgctgctgacactggatgtactcaccttaggtcctcccactgccaggctgcctggcctcgggaacacgctgacacacacaagaatacacactggagctggcttccttcctcctcacaactaagtatattcctgttctagaagtcccccaggatcatgttagacaatgtgggaaacagacgggcagaaacagaaagggaagaaagagaacccaatgtccccatgcaacaattagactttggtgatggaattttctcatattatagaaggtgccttgtcaacatcatgggtagtgacaatataatattctatactgttctcattcatttcccattctctaatacctgtggccacttggttttttaattttttgtcattatgagcattattgtacataaaaatttccccatatttttgggtaatttacttatttttccttttttttgttttttttttttttggagacggtgttttgctcttgttgcccaagctgtatgtagtgcagtagtgcgatctcagctcactgcaacttctgcctcccgggttcaagcgattcttctgcctcagcctcccaagtagctgggattacatgcatgcaccaccacgccctgctaactgtatagttttagtagagacggggtttctccatgttggtcaggctggtctcgaactcctgacctcaggtgatccacctgcctcagtctcccaaagggctgggatgacaggcatgagccatttttgggtaattttcttagaatttattttgaaagcaaaattaagtcaaatttcagcctaatcaaaactaggtaaaaagatgctaggtcaagggatattgatacatgttgctaaattgttttccaacagaattggaacatcttttttttctgcccagcaatcattgacaccagtttatcagatatccaccagcaatgtgttatccttttttggaaatatttatacaattttatgttagactattactgtaattaaactttcccacgtgcttgttaacagtatgtggaaattttccatgtgtttcatcaacttgccgtgtccataacaatttttctaattgattgcctgattgctttatatagcataaatatttcctgttgtttcattcaattttgattttttgtagatacatctattttttcatttttaggtagttaaatatatcagttttttaatttattctatttattaaccttggttatttgttatttttatgtattttacttttcaaatttatttggaatccagcttctgaaggtacaaattattttctgtataccaaagcaatgaacatttcatgtgtcattttagtaaaatgttttatttccttttggatatatactacgaataggattgctatatcagatggtagttctgtatcaagttctttgagaaatctccaaactgttttccacagtggctgaactactttgcattcccaccaacagtgtataagtgttcccttttctccccagcctcaccagcgtctattgtttcttggcttttgcatagtagccattctgactagtgtgagatggtatttcattgtagttttgatttgcatttctttgatcagtgatgttgagcattttttcatgtgtttgttggccgcttgtatgtcatcttttgaaaagtgcctgtttctgtcttttgtccactttttaattggcttatttggtttttgcttgttgaatgaagttccttatagattctggatattagacctctgttggatgcatagtttgtgaatatgttctcccattctgtatgttgtctgtttgctctgttgatagtttcttttgctgtgcagatgctcttcaggttaagcaggtcccacttgtcaatatacattttcattgcaattgcttttgaggacttactcataaattctttcccaaggccaatgtccagaatgatgtttcctaggttttcttctaggattcttatagtttgagatcttacatttaaatcttaaatccatcttgagttaatttttgtatatgatgaaaggcaggggtctagtttcattcttctgcatagagctagccagctatcccagcaacatttattgaataagtagtcctttccccattgcttatttttgttgactttgtcaaggaccagatggctgtaggtgtgcagctttatttcttggttctctgttccactgggctatgttgttttgttttgttttgttttttaccagcaccatgctcttttgatatagtttgaagccaggtaatatgatactgatacctccagctttgttctttttgcttaggattgctttggctatttgggcttttttttggttccatatgaattttaggatatcaacttgggttacatcagtggtggattggataaagaatatgtggtacatatgcaccgtggaatactacacgcagccaaaagaaatagtgaagtcatgtcctttgtagcaatatggatgcaactagaggccattatcctaagccaattaacacaggcacagaaaaccaaatactgcatgttcttacttatgaaaggaagctaaatactgagtactaatggacacaaagatggcaacaatagatactggagactaatagagggaggagggctggagtgggggaaggattgaaaaactaacctgggtactatcctcactatctgggtgatggaatcgttaatatcctaaacttcagtgtcaggtgatctacccatgtaacaaacctgcacatgtactccctgaatctaaaagaaaagttgaaattgttttaaaaaattgttgaaagaaaaaaaaataataagtatgaagaacatttcttaacagtattttgtagtccatctcttccccactgatgtggatgactttcttcaagtatcttaagttttatgtaactataatctacgtctgaatgatatgtcctcttcttttttcttttgttctccagcaacttttcttggtcaaagaatgcagaaggatatatggtgtctgtggtttaattaacaggattgtttgtaaaacaactttacatttatcttatttttaaaattcttgcttttgaatagctgatgtattagaatagacactctcctatcccatgcaaaaagctgttaaaaaatgagcagcttgcaaatctatcataaatgagacattgaataaagcattcttacagtgagggctaaggagcagttcagtctagaatttgcttcagatactttttgaaataaaatattcaaggcataaaaaagcaaaactcgaaatatctaaaacagatacctactgatatttttaccctagtctcttcccacagtttttatgtgtctctgtgctccactgattcaaacaaacaacaagagcagtaggcatcttctaactaaaagttaatttactagtcttcaactaaaaagtcacagtggaagaacatatgtaaggtgaagaaagctttttaacctttcagacttaaataatactgtatttcaactttaaagaaaggctccactatatattttctgcattgacattttaaaatatatgaacaagtctttgtggtacaatatatacttcaatatatccaatataccttatatgaattaaaaacatgtcaacttgataactgtagtaaggcatttaagtattcagaggagccataaagaaatttcttaatgagtgctgtccttttaatattaactggatttagtaggtttccttaaaatgaacaggaaacaggccgggcgcggtggctcacgcctgtaatcccagcactttgggaggcctttggcaaattagaccccaccccatctgagacttcacctcctgcaactctgccgtccaccacccttactctagccacattactgccaagcataatcttaccatagggcctttgaacgggctatgcctccaccagaaccacttttcccgtttatctgatcactccttcaccttcaagtcttgatcaaatgacagcttcacagtgacaactttccagtccatcgtaatacagattatgcttcccctctactcagccccaccccttgatatctgctttattttcctttatatgacttatcactttctaactttttaaatatttcagatatttgtgatgtttgttgtttgttggctccccctaaaatgtatgatccaagaatgctgggattgctgcttgttctgtttcctgctgtatcccaagcacacattaaatctctttggtgtaagactcaatgacttaaatacttttcaattttatctcttgacttggtttgatcatccatatttttttcattcaaaaggaaaacacttctataatgtcactattgatacttttttcatgaataaatttgttttcaaacagttttactgtactttattttctatcttgtgaatgtttgaacaacactttcaattctttattcagcgttttggagatttggtgtttacaaatgttgtttttacttctgaaattaattttattgccaaaatatattttatcaacctcaagaagtaattgttgattattcctatggagaatttgccaggtgaataatatttctcccatgatcttttctcactttcctcccttatttaattgaaattatcttgaactagcagacccatttttaaattttataattatgaatatcaatatacatgtcttcttaaatcatgtttaattagctttgttttggaaagcgtttatgactataaccattgatctacatataattacatgtttatatggttccaatgcttgtcacaaacctttctactacttgttttattcctgcttctttgaaattcatcatagttttttatgtaattctcaaaggtacatttttttaaaggaaaactatgggagataagtttatttaattccttgctcctataatcttatcaatggaacaataactttgctaggcatgcagttattaggtaacaatgtttcctttctctggcctctttttgtgtgccaattctgagttctggagatatggttccctcctctcctagtattcaatgcatggagggtatccctgccttcccttcttctagtagataatttttgatagtggtaatctttgtgattgttgtttttctatctagaagtttgcattatttcttcttctccttcgtcaactcctcctttttcttcttttttttccaaaactcaacttcttaataatttgtactagtaccaaaaagcttctttactttaaggtatgagagatttccttacgtttaactcacttttccacatacatatttctgattgttgcttctgccctttttcattcttgcctctttttttatttaacttatcttgtttgttctttcattctttatcctgaaatatttcttcatatactgatgatgtatttatatcctgatctttcccttattaaagtccataatttttaccttaatctttgtttctaatttcatacatatccttttatatttctaccttcatctaatctatctccttgtgttatcttcttgtcttttatttctcatatattaggactcttatttgcaagtgacagaaactgaagctgcactgagccgagcatacaggagcttaatggtttataatcctaaaacattataatagcgtgtggagtaccaatgcaataacacatcaattacaccatgaacacaccattaaaaatgagaatttgtaggacactcaagagacatataaaatgctaccctactagagaaaaatgtgataatattaaatataggctaaaaaagattcctactgtcaaaaaagttggttattttacatctatcccaagtttaagtctggtcataattacccaaaaataaatttaacaaacaggtcccagagttcacctaatgaataaaaatggcttagcggagttttggttaaaaaccctgtagaagttgcatttcaaacatccactaaatcacagatgttactgaattattgggccacccattgaaatacctagcagatgatatggtccataagcatcccagacatttaagaagtatagtgaaccaaactctcaatcaacagaagactaatcacccggccaattaatttgtgtaggctaaggctaaacttacatcaagctccaatactgtgtattctgtgaagatcaatagagaaagatcttcttcccttcttgtcctcaccctactctggacctctgggttcccaatcccctgaaggcaaatatccattattattgtggctcaatttgtactttgacaaatattgacatctatttcaaagagactgcaaagaaatctggtgttcctctgagttttgttttcatcttgcctttctcaagcataaattaagatattatgttaaatgtttgtttttgtagcctaattacactgaatacactgtcgtcgatagtgtttacatactgcaagctacttaacatattatatatagtaggaaagatgtgtttaaatatgtttgcatggcttaaacttgtatatctcaaaaatagtcttgaattgttatcaagcattgccattagtatgcttttttcagttctaatcaaaatatatcattttattatgctttccagttttactctagaaaatgttgaactgtaactgcacattcaagtctaatgtactgcttcaaaagcaatttgagcgatcttttatctataaatattataatttggtgatggtgtatgtggaacagaaaatgcttgttcaggatgtggcaaatacagccacctgcctgggacagttcacggaggcaggaagactccaggctggaggggaaattaggggatgcttccgagggcaggaggcagacataaagaaaaatcgtggaggtgatgtgggagcataattcatggctttgggtgccaggaaaggaggtgaaaatcctaggaaaatccaagtagggtgaatgagattgcagcaaatccataacactattgaaaggggaatcccctgttctctagagtttaaaggcccttgtttattcactgagagttgtcaggctaattatgggctctggttttctgctccttgagggaagtggcctcttgactcataatactaacaataaacaactccactttgtagggcttgagttgagttacggtttttattttagagaaatggaatttttcccctaatactcagacccagacctgtcacagatttcggtggtttcacagagactcctccaagtctacggcactcttggtcgctttgctttatggcaacaacatgccctccatctacttgattttctttcacttggtttggtgaaatagaaacgtgatgctgaggcctgtgttagttgagagttatgttcttggagtggcaagactcagggtccagggcatctgctcttggagtagctcccttgtgacccggatatttgccgctaggcgatctttccaggtcagcatctcacgtgcaggagacactcgtccgttcgatgcctctgaccgcaccgtccttgcttctagtctcacctggacaccaggagctgcctcttgctatcagcactcaaagcagatgcagccgtttggtgcctgtgcaaggttgcaagtgtgtggttggatgggaggcttctcctcgaccccctggtcccatgtctcatgcatagaagaggaaagtcagggccagaggtcacctggcccgttgaaggtccttactccaggagcagatcctcaatgggagtccagatttcaggtgcacaaggcgtgcggtctttcggcagctcacgccaccatgcacgtggtgtgtttctgctccatgcttctcctacggaggccattccaccgccatggcgtaaccagggaggtgggcgaggccagggccagttcctcacagtcgggggaactaagggacctgactccagcaggtcctggattaccttgatgcatcccagggggagaggttgtgttctgaagattggaggagtgtttgatttatttacatgggatttgttgcaatacatgttgtgaataaattttctttataactgtttcagtataagtagatactgattatctataagaaaattctacaatcctttcaaaagtactaagtaaaataagaagtagaaagtgttatctcggccgggcgcagtggctcacgcctgtaatcccagcactttgggaggccgaggcgggcggatcacgaggtcaagagatggagaccgtcctggctgacatggtgaaatcccgtctttattaaaaatacaaaaattagccaggcgtgttggtgcatgcctgtagtcccagctactgcagaggctgaggcaggagaatcgcttgaacctgggaggcggagggttgcagtgagccgagattgggccactgcactccagctggtgacagagaatgactctgtctcaaacaaacaaacaaacaaacaaacaaaaaaccaaaaaagtgttatctcttgaaatttttaactctgaaaatccaccctctgcacatcttacatagaacaagacaggcagccacaatgtgccatatgtgttgatataataccgcttaatgccagcacgtgtaagatctgtgtcccttctctgtgttccaatgagcagacaaagcttcaaaacattagaaatgtagaaagaacttaaacttattgcaacttactctttattcccactgctaatcacactttgtcatctgatttttatgtaatttttcttccaggtggcctttagcttgaaactcaattgtatagaaataaagtatattattttatataagatatgcctttaaattgatattacatgttcatgttacattcaatagggagcgactttattcttggcacaaacagtccctgaaaacattaagctcactgttgacctcaatcgtggtcattgttttcttgtgtgtatttgttgcacaatgactttaaatataatgtctgaaaaatcacagcatggggctgtgaatactggttgccctgtatagctggagatttatagctcctgtcagtctcccagggatctctgagatggatttaaggtgtgagtggtctccacactttctgggcggctttctcttctctacccagtgaaaccgactgctgtgatgagctggggttggagctgtggctggggctgtcaagatactcttgttactatgatcaatcacagccaggtccatgaagcagttgctagttgagctcagcaatgggattagccccttttttcaagtacttatttagttttataaattttagttgacaaaaatatatatttaaggtgtacaatatgatgttttgaaataagaatactttgtggaatagctaaatcaagctaattaacatatgcattacctcacattttttgtcgtgagaacaatgaaatctactcttagcaattttcgagaatatgatacattgctattacctgtagccaccgtgaagtgcaatagagctcttaaacttgctcctcctccttgtctgaaattttgtaccttttgtccaacctctctcaattctgtccctcagccccatcctccgcagcctcccttccactctctactcccataagtttgagtgtcttcaggtaggtgagatcttagggtgctcggcttcatgcatctggcttatgtcacttaataccatgcattcagggttcagccctgctgccagagacagcagggtttgcttcttgtttaaggatgaacatcgctgctgtgttcatgttccaccccattatctgtgtgtcagctgatggatgcttagggtgattccatgtcgtgtttgtttctgtgaacgatctcattgatgcctcatgcatgccacctgagtcccgcatgtctggtgctctctgcctctgaaatccctggccagcatccgggcacgggggcctgcagggcagatcccagccccactgcctccagagtctccacactgagcaccttgcagcctgccctcctggcacagctgcctccaggaggagccgctatgggaacgtttttgttctcagtaatttaaggtgcttgctgagagcctgatgagaaggaatttgtagcataggaagcctctggtgaaatttctccttggcattattgggaccaaatccccatagtgtcacattgaagtcaacgcaacaaatgtgaactgaaatgtcgcagtgtacccgatcctgtggcccccgagtgccctgtcgctgatggtccggtgttctgggtgcggaccaaggaggagccggtggcaaaggcgcctcaggcaggccctgggctccatgggcggcttgtgctccgcgattttgaggccatttgcagcagctccgccagcccaccgctctgagctgcagccgctgccagccacaacagcaccaccacgagtgtcttgggggctttcttcagaggaggctgtcagcgtcctcaagttccaggcgctctagcctgctacaacaggctttttcccacctgcggcctctcctcaatggcctaaaagcttggccaactcccacaaagtttggcagtaacacaggctgtcactgacatttgtggcgccaggacttgcccacgcgggttgcaaacgtcagccactgtctgtgtcacgtgcagtgacgccgcccgaggtgcgcacggtgcgcacaccgcacgcgcacgcccacgtaacggcttggctgggcacccccgcttggcttggtggtcctggtttggattggctttaccctggcattcctttgctgggcttgaccttttcttgctgggcttggcattcccctggctgggctgggtgtttccccggtggggcgtgcactttccctgggtggtggagggggcgtgggctctccccgggtggtggggggacgtgggatctccccagttggtggtgggggaggggtcgtgggctctcccagggtggggttttggctgggattgacctttctcccctaacagattggaaactcgtaatttcccgctttttggtgaaactcgttgacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagcttagcattttgacaactgagaataaaatgctcagttttgaactgcagaatgtaagacacaacaatgaaacactggaaatggaaattcaatcatgtcattttagactggctactgctctacatgattgtgactgaagtcagatagcagaaagagacttctttccagagaacaagacatgaacaggtttatttacaggagacaatgaattctcatatatctaacctaaaaggtaacagtgagattctttctgagcaactctaatgctaacagtaaaattaacagcctgaaaattaaggtccatcacacaagataaactctgagagaaaagacggggcaggccaccatttttcctttttgggcaacttagtcattccagcctgcaggctttggagagtacaaaccgaccaggggaagaagacatcctgcagcacagcacagctgctttatcaaatcatggccagactgcttctgtaagcaggcccctgatcctgtttctcctcactggaaaggacctcccagctgaggcctccagctacccccaccagtgttccctggccaacagagatttaaatcccccctgggacagagcacccagagagaggggtgggtcaccacctttgctgtttgggcgactagccattcaggcctgcagactttggagagcccaagctgaccaggggtggaagtggtacctcagcacagcacagctgccctatgaaaatgtgaccagactcttttttaagtcagtccctgaccacatttgttatcactgagtggagtctttcaaccagggtctctggctaccttcagtgctgttctctggctgacagaggtttcaggccttcctgagtcagagctcccagggggaggaccagattgtcatctttgctgtttgggcaactcagccatttcagccttagggcttcagagtgtctgaggtgatgaggagctgaagtgaacccccagcatagcacagctgctttaccaaaaagtggccagacctacattttaagcaagtccctgttcttgttcctcctgattaggcaagagttttttccacttgcctccagccacctcctacaggtgtgttcagattggcaacaagtttgtacctcagtggtacagtactcccagaggaaggggcaggctatcatctttgccttttcacagccttcattggtgataccttcaggccctggaaaatatgaggcagttagggactggagtgcacccccagcataccacagcccccctacggaaaagtggccagactgttacgtgggtgccagtttccatatcttcttgatgggcaggtcttcccatcctgggtctctagccagcaccccactggagctaccaagccagtagcaactcagcaattccctggacagagcttccaggagcaactgaaatcctctatgccactgcctctgcagtggaactgtccttgctacccttggaatatcaagggagcaaagactttaagtgctgtattgacatgtccaacaagttgcagttgacccagtgagcaagccagtccatctcccatgggtcccacacactctccactgttcatcacccgacagggaacgctggcttgggcccacagcacagacactccatcctgggctgatcgcactaagtgattgctaactcacatctctctggggtggagcccctaggagaaaagccaagtggtagagcagcaagccagctgatgcggagcccaaagggcagggacagctatctctctaggcaccatttgctcttatgagacactttatcccagcactttaggagtgctgaggtcagaccagccacatcttatgtgcaagattgcccagcagagatcaggtctgagagttcccctcttaaaaaaaggggacttgcttaaaaaagaagtctggccacatttttgtagagcagctgtgctgtgttggggctttagttttgagagagttctcctctgagacctgatctttgctgggaagtcttgcatatgagatggggctggtctgacctcagcactccttagtctgtttgcctctcccagggccccagcctggccacacctgcttacagggcactctcaggtgctcacaccatagcttctgtgccagtggaccatgtctgaccaatggagggttgcagcaaggtggcccctacagccatggaccagcctgcatattgcctctacatactgcagctctttatatgcaaacttcctacatccctttgctggtgtgtgtttacatgggtgggttttgctgtacttgccctaccagcacacgggagtgcatcacacaccccaacccacaccaactgccattgaagatggagccctggcaggcacagagccaaaaatcccccacccccaccagcacctcacccttgacctaatgctgcagagaggaaaagggaccctcttatatcctgagggaccactgttgcttggggagcacagagaaggcacctagacccgtgctggccagcacctcaccccaaaccaacactatctccagtgcaacagcacacacagtcagcaggggccccctggtccccaccctagctgtcttgcctccaccactgggtgaatgcccacagggaggcaggcacttttgcatccgctagcactctgctgcagttgccgcactttggtcccctcagtgcagtggaccccaaacctcgaggagccagagaacaaagttggggcccagtacaatttcctcagagttaaagcacacagtccaggaattgggagctgaacactggctccctaaaatcctccagaaacaaagccagttggctgaatccacctgacaccacaatcaaaccctcaaggtcatcaaatgtgataaaagaaaagtactctgtccaaaggtcagcaaccgcaatggttgaaggtggataagcctataaagatgagaaagaatctgtgcaagaacactgaaaactcaaaaagtcagcgtgtcttctttcctccaaatgactgcatcaactctccagcaagtgtttggaactgggctgaggctaagatgtctgaaatgatacaagtagaattcagaatatgagtaggaacaaagttcactgagtgagagaagtatgttgtaatccaatgcaaggaagctaaaaatcactgcaaaacattgcaggagctaacagacaaaatagccattataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaagccattataaagaagaacataaccgacctgatagagctgaaaagcacactagaagaattttcataatgaaatcacatggtgattatgtgtgattgcattatgaaaattcttgtagtgtgtgtgggcacctgagagtgccctgtaagcaggtgtggccaggctggggccctgggagaggcaagctgactaaggagtgctgaggttagaccagccccatctcatgtgcaagaccacctagcagaatagaccaagcagaggaaagaatctcagagcttgaaaactggatttctgaaataaaacagggagacaagaacgggggaaaaagaatgaaaaagaattaacaaaacctctgagaaatatgggattatgtaaagtgaccaaatctatgactgattagtgtacctgaaagagatgaggaaaatggaaccaacttggaaaacatatttcagaatgtcattcatgagaatgtccccaacctagccagacaggccaacattcaaattaaggaaatccagagaacctcagttagatatgccacgagaaagacatccaaggtcaaaatgaaagaaaaaatgttaaaggcagctaggaaaaaaggtgaggtcacctacaaagggaatcccatcagacaaatagtggacctctcagctgaaaccttacaagccagaagagatattcaacttcttaaagaaaagaaattccaatccagaatttcatgtccagctaaactaagtgtcataagtgagggagaaataagattcttttcagacaagcaaatgctgagggagttaattaccaccaaatctgccttacaagagctcctgaaggaagcactaaatatggaaagaaaagaccattaccagccactacaaaagcccactgaagtgcacagaccagtgatgctaaaaagcaaccacatacacaaatctgcaaaataaccagctaacagcatgatgacaggatcaaatccacatatattattactaaacttaaatgtaaatgggctaaatgctacaactgaaagacacagcggggcaaggtggataaagaaccaagacccgtttgagtatgctgtcttcaagagacccatctcacctgcagtgccacacacaggctcaaaataaaggaatgcagaaaaatctttcaaacaaatggaaaacagaaaaaagcaggtgttgcaatctagtttctgacaaaacagactttataccaataaagatttatcaagacagagaaggacattacaaaggtggccctgacctttgataaatctcattattggttgataccaacctgggctgtctttttttgttgttgttttttgtttttacttttgagaaggagtctcactctgttgcccaggctggagtgtggtggcatgatctctgctcactgcaacctccacctcccaggctcaagcaattctccttcatcagcctcccatgtagctgggattataggtgcatgccaccacactcggctaatttttatagttttaatagagaccgggtttcaccatgttgggcagactggtcttgaactcctgacctcaagtgaaccgcccaccttgtccatccaaagtgctgggattacaggcacgggccactgtgcctggtcaatctgagctatatttattgctgaaaccaataggataatttgctgaggttgagaagtttctcccctccagagagtccctgatcttccaaaattaggttgagatctaaggttgattttactgtacaactccttttctgaagttctacttatttccaacaaggaatgcaagttttcctgcttccatgatgatggagagcaggcacctcctttcttaagtttcagcttgcagggaaggtgagtgtgaattttttcctgcttctaagatgatagagagtgatcatcagcctgagactttttccaggtaagtagctgaagtagagatttgtcttaaaaattttccttaatgactaaaagttaagattaccaaccaactggttttaatttctccttgcctttagaacagccagtaatcatatgaattgtgcatttgtttgttttgcttaacggtttttgtttgtatatgtttggggtttattgttgttgttttacttttctcccatcaagtatgatcatctcttcctgacttggtcaaatccaaaggaatgttccaaattgtgaggaacaaggcatcagaataggccaaaactcctgtagctgcaaaaaaaaaaaaaaaaaatccagttagaaataatttttataaaacttagaaaaaattaaaaaaaatttttttttcttaagaggtttcatgtacataaccaggccatcttttgccagccaagagcaaattgaagaagcagtggtggccacccagtgctaagattctgcccaaacaatgtttactacagcaacctgagtttgtttcctaagtctagttctttctggtttggtatttgtgttacttttaaaatgccagcagtttgtcctagctatgaggctgtagtaagagattcaaatgattttttttaagagctccatgataaaaagcttcattaaaaacaggtattatatatatgtaaaaatatatttaaatataattacatatatgtcaaaaatatataaatatatgacatatttatatataaacatataaatacacatatttatgttagaaatatgtttataatttgttatatatattttttgtatttgtgtgaatctaaaaggcctttctctttttggatttttttttttgagaaacatttgattttgttctcagtcaactgaattctatctctccattttacgtatgtctgtcctttctttttcttgctacccttaatgcccacataaaagacgtaaagtaatttctgataactggggattgcttaaaacagaaagggcaccagacttctttttgcaaggaatcactgtttttgtttctaaaatcccaatagttgtaaacagacaagtttttttgcagctcttaaactgctcactttttaaattgcattattggatcttaatggcttttttcttttttttttttttgagacggagtctcgctctttcactcaggcagactgcagtggcctatcttggctcactgcaagctccacctcccgggtttatgccattctcctgccttagcctcccgagtagctgagactacaggtgcccaccaccgtgcccggctaattttttgtatttttagtagaggcggggtttcgccgtgttagccaggatggtctcgatctcctgaccttgtgatctgcccgcctcgggctcccaaagtgctgggattacaggtgtgagccactgcacccggcccttaatggcttttgagggtttcaagaatcactttgcacagtgagaaagtttttgaccttggagtgtgtaatagctaagtaggagatatatttttagggctggttattatgggatatattttttcttccttttaactaatttgtgtctttacatttaaagtgtgtttcttataggtagcatggagtaggatcttgctttctacatagtttgacaatctgtgttttaatttaggttgttaggcccgtttcatttataatgtgattattgatatattaatagataagtttatctgtcatcatgctgtttgattttcattagtcccagctattctttgttcccttctctttctggtttcctttcaattagttatgtaacttttatggtttagtttcatctctcattttttggcttattggctctaattttttttttttgctatcttcgtggttgcattacagtttgtactgtatgattttaacttatcacagttcactttcagacaatattatatcatatcacatatggcataagaaaatcagaatttctattcattactactttcatttcctctctcccagccagattcttcctggatttgtggaattatagttttcattaagtttagaaagtttctgttcattttctctttatgttttgtcattgtctcttcctccctctttggggacacgtatattattgcttaaagttttcgcataattctctgatgtctcgaatttatgaatcttctctttcttggtatctagtcagtatttgcttccacccagtgtcgttttcagtcatgactttgtttttgtttgtttgtttgttttttgaaacaaagtctgactccattgcccaggctggagtgcaatgactcgatcacctctcactgcaacctctgcctcccaggttcaagccattccttctcctgccttggcctcccgagtagctggggttacaggtgcctgccatgatgcccagctaatttctttgtatttttagtagagatggggtttcactgtgttggccaggctggtcttaaactcctgacctcaagtgattcacctgcctcagcctcccaaaatgctgggattacgggcatgagccaccatatctggcccagtcctgacattttaatttgaattcctactagtgtaattttctttcaaaaaatatcttccatgcctctacttgagatttatttggggacacagttgacttataaacaacttgatctttctggtcttgctttatgatttggtctaattttccactcctgaatcaaggtgtttctgataactctattctttgccctgtgaagtcttgagttttttcagtatcattcagaggaatggacactcttcctggtaggttgtgagcaacaggcactgtttcttacaatttttttttttttttttgtgtttaactcatctgcatgtattttcttttttgcattttttttttaatgttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgcttggttttttgttcttgcgatagtttactgagaatgatggtttccaatttcatccatggattttttccccctggtctcaagtagtttcttaggacaaatgtactgttcattattctgctaaataaatacccaagagggtgtttttgcagatctccagtgttctttccctttactgctgtctcctttcaagtattctgtgatttctgtctgccttggttttttgagactctcggcttcattgttcaaactcagggaatctggtgggctctacctcagtttttggtagactctaactcagttttttttttctttcattgtcatggcctggaaactttgtcaagtcagggagctagggtgtttgtaaggcttatttcacttgtttcctatcttacaaggatcattgtcttcactacctgaaatccttgttcttgaaaatcgtggtattatgtattttgtcttttttgtttttgtttcaggtgagaaggtaagtcagtatctgctgctccatcatggccagaagcagactgcagcagagcttcagcacatgacataaactagctagaatgtttttctaccccctttacttaacagcttccttctcacccttcatttctcagtgtagccatctcttccccagggaaatcttcctgagcccagtatagatcaaatcctgtgtgatcatagaactgttttcttgcagcatctatctgaagttgtaatttcacttctttgtatttgttcttcactacacttacagctaaacaagagcagagttactgtttgttttatctgcagagctcagtagactgtgttccccgtggtaggaactcaatgcatatttgttttgtgtatgtgtggatgaaaatagccactatgagcaacttacagtagaaattgaacaaatggacaatatggtttgtgtactacaaaaggagctgtctgaggcaaaaggaacacaattacagttagagactgggtttcaccatgttggccaggctggtcttctcacctcaaatcaaccacccgccttggccttccaaagtgctgggattacaggcatgagtcaccgcgcctagccaacctgagctatttgtattgctggaaacaataggataatttgctgaggttggggagtttctcccctccagagagtccttaatcttccaaaatttggttgagatccaaggttgattttgctctacgactttttttctgaagttttactcatttccaataagaaggcatgttttcctgcttccatgatgatggagaacaggcacatcctttcttgagtttcagcgtgcttctgacagggagggtgagtgtgagatttttccttcttgtaagatggtagagagccatcatcagcctgagccatatttccaagtaagtagctgaattagaattttgtcttaaaaattttccttaatgactaaaagttaagattaccaatcagctggtttttatttctccttaccgttagaacagtcactaatcatatggattgtgcatttgtttgttttgcttaaatgttcttgtttacatttggtgttttattgttgttgttttacttttctctcatcaagtatggtcgtctcttcctgacttggtcaaatccaaaggaaagttccaaattgtggggaacaaggcatctgaattggccaaatcttttgtagctgcaaaaaaaaaaaaaaaaaaaaaaaaagttccagttagcaaaaatgatgttgtaaaacatttttttttttttaacctaagagttttcgtctacataacaaggccatcttttgttagccatgggcaaactgaaggagcagtggtggctacccaatgctaagattctaccgtattcactacagcaacttgagttttgttcctgtctagtgctttctggtttggtatttgtgttactttaaaaataacagcagtttgtctgagttatggtgtgttagtaagagattcaaaagttttttctaagagctccatgattaaaagcttaattaaaagcaactttgatatatatgtaaatttatatttataattacatatatgtcagaaatatataaatatatgacatatttatatataaacataaatgtacatatatatgttagaaatatgtttacacattatatttttaacctataattttttttgtgtttgtgtgtgtctaaaaggcctttctctcttcggatcttgttttttgaggaatatttgtttttgttctcagtcaactgaattctgtctctttattttacttatgcctgtcccttttttctcttgccacccttgatgcccacataaaagatgtaaaataatttctgataactggggattgcttaaaacagaaagggcatcagacttctttttctccaaatcactgaaatcacagattttgtttatcaaatcccaagagttgtaaacagacaagtttttttgcagctcttaaactgctcactttttaaattgcattactggatcttaatgacttttgagggtttcaaaaatcactttgcataatgagaaggtttttgaccttggtgtgtgtaatagctaggtaggagatatatttttagggctggctatcagaagagatatttgtatgcctttggctgcctggaaggtatggaaacatcccaatgctccactgaatagtgagactaccatgggatatgagctgattattgaatgggctaattggcttttcttggctaccaacctcaggggaaatgtagtgaaatgcatgttaaaaacatggcattgtctcatcccataatgttttcctcttttcagggcctgaggattttatgtaaaaatcaaatacttgatttttggatatctgttctgccttacagctgtgccttcatgttaggccctagaagctgcatgcttccttggccctgtttcttaaaaggctccagcctaaagccagtaagccaatttttaaaaatcttcaaggaaatcacatttaagtgtgtctgctttccttggccatcttaactgaacttttacaccatttttttttttggctttagtaaaatataaatcctccatcttgtttcacatgagtcatctctttaaaaatgcaaatttagaattgcctcactaataactgtttacagtagggaacaagtattcaaaagacgaatgtgctaaagtggagaggaaaaactggcaaatgaaaaatcttttgaatccctaagatctacttctgtgtgcctatatgtctaaatatttatatgaattatgcatgtaatgtttgaataccaaaaatatgtgaaaaggctctaattggctttttaaaaagttcttaaatattgtatcagaaattagaaattagaaacttattcccaaatactttttcaagttttggttaaaaagaaacttcaagatgtcttcacaatagttagcatacattattgtttagatgtattggtccagtggtttttttccttttttcttttttttattttctggtcaagtggttttattttatatcttctagctactataacatgtcaaaatttgccacaaagttacaaactataaacccagacccaaacaataatttttgttcatgtaatttttgataaatatttaatattgttgatttaatgaaaacagctcaatccagagttatcagtaaataaaactattaataataagttaggtaaatgtaatagaataaaagcttataaatgaacttgtcatataagttaaatcttaacattatattaaatcaaataatagatattagatgtctggatcattatcaatttttaaactatattattggaaacattttcaaaataattataagatagtcctcatctataaaatgctgatgtgacaataaagatttcttacttcttaggttttcaccaaaaatttattaccaaaaatcaaaattttagttaatatgtgattttacatataaagtgtgccaaaataagttttattctgatgaaaaaagaaaaattgtgagaaataaaaatgaaataaagaaatgataagaaacagaatgaaaataattgttgtccaattcaaagattattgaaggattccttatgaaacaatgtaaagggaaccagtaagtgacagagagatttaaagaaagttataaagagattataaagagatacattcagtaagaaataccacaaagatgctgggcacggtggcttatgcctgttatcacagcactttgggaggccaaggtgggcagacaagatcaggagtttgagaccagtctgtccaacatagtgaaatctcgtctctactaaaaatacaaaaattagctgggtgtggtggtgtgcacctgtaatcccagcaacatgggaggctgaggcaggagaatcacatgaacccagaaggtggaggtttcagtgagccgagattgcaccattgcactccagctcaggtgacagtgtaagactctatctgaaaaaaaaaaaaaaaaaaaaaaggaattattacaaggaaaataattttgtataaaaaattgtatggtagatttttatcctaaaacaaaatggctggttatttaagaaagaggatatttaggacaaaacagaaagtctaagcatgttataattggtctgtgtaataatacgcttcattaaaaagaaaattcttttaagaattttgtgtgtgattcagttggctagaatggaaggaaaattattcataatagcctttctgaaaaattaagctttgatttttaaaatacactagaagaaaacaaaaaaattgattagaaccacaagatgcttttaagcattaatttaataaaattgtaagattttttaatgtttaattctataatctgtttctaaaaggtttctcagatgaatatctcaaaagtttaatttttgctgaaccccattgcttccagcttactcagcttattctccctttgagaaacctgggatagtaactctcttcttcaacttttcttgactccagtagcattttttttcttcctccaattctaaatctgttgttatggcctgatgatgaaatgttttatcttgaaaagtatttttttttaaaggcaatgttttcctccagtataagttaattctacactgttgccttttcttaatatgtttatgggccttgagccctctgaaggttagcttaaaaatcaactcagaaaagaccaatcgattaaagagaggacaggcagatttgtttctgaatatatacatgaaagttttcaaaatagaggcccaatatataggagaaattgtctatttttcattgtttagtttcaacaaattatggaaagccttgtaaacaatatgcttgaaaaaactttataatgtagttctggtggactttgagggaatatccaagaaggcctgtctctctagattcttctaaacctttctgagttagcatttcttctttttagctatggggcacctataacctatagtacaacaaggaaggtcagataagttctttatggccagttcttagacagaaatttgaagaaaaaattagattaatactttaaaagttttatggctggctctgaacaaaaagttacagattctagggcccacctggaaaatgaagattctagtttctgtggccaggcttgagggaaactggaactgaggaacacaaggacaggagaaagccaaataaaaagttttatttctgagggtgcttctgaaggtttcattttggggtattgtttttttcagtccaacatatgtccaaagtgttcaatataattaggcaacttcccatgctgtggctaagagtcacatattctgctcaagacttctatgatatagtgtttgcatgttacactgggcatactctttctgtatctgactagttcacgttttcttttcatcaggtttgactgtcaggttgtccaaataggcttcccataaaggagaaacagtcactgaagaaggttacttttttcttttattgttaactaatcaacaaacactttaagataattcctgtgttgttttaattagtttttaaaaattattacaaaactaaactttaacagggttaagggccttacatccatgtaacttcctatattgctgttaagatcttttcatttcactctggttaaatgaagaactattattttataatggcccgtgattctgttgtaatcaaacattttgagttttctaatatcttttgacaaacagcctcaaatatcaaatactgaataaagtctctgacttagacttgtagctggtggcttatcaaaactataaaaattaaccactgcaaggtcataaaatcttcttacagcttccagttaagtcatgaactccagtatcaccctctccaggctgatgattgggcatcagctgagagactcctccagcgccattgaaaagggtttttatcaaatagtgtaaattaaactttttgctgttaagttgcagggctttgactcctgagtacttctatctcatctaaaaggtagcactggctcctgctgaaacttaaacatcaatgctgatatctggcaccaaattctagttaatgaaagccccaccttcaaacctgggagaagatgagagtcaaaacaacttgctaatgctatactttcatgggtcatttctatagtttgttattagagaagtttctctgaatgtgttgagcaccagaaaccacgaggagatgcagcattctctcctgaacgggaagccagcttttggcattgctttgatgcaactaccatttgccattgatggcaatgcatcgcttcctctaggagtgtaagagggagtggatgcagtcagagtggttttttaaattaaaaaaatttaaaaaaaaatccaggctgggcatggtggttcacacctttaatcccagcactttgggagaccaaggcaagcggatcacttgagctcaggagttcaagatcagcctgtgggcaacatggcaaaaccccgtctctacaaaaaatttaaagtagctgggtgtgttggaatatacgtgtagtcccagctacttgggaggccaaggtggtaggattgctttagcccaggaggttgaggctgcagtgagtggagatggtgccactgcactccagcttgggtgacaaagtgagaccctgtctctctctctctctctctctctctctctctctctctctctctatatatatatatatatatatatatatatatatatatatatatatatactttcttgtgatactgtgctaggcctctatacaaagacataaatactaaatcattttcctctattttaatataatttgttctatgccttaaaactagataatttaaatgtttagctacctgtgggttttttttttctgttattgtcagagctaggcagggcttatgtcctttgtgtttaaacatttttaattctgggccaggtgcggtggctcacatttgtaatcccagcactttgggaggccaaggcaggtggactaattgaggccaggtgttcgaaaccagcctgtccaatgtggtaaaaccctgtctctactaaaaatacaaaaattagctaggcgcagtggcacacgcgtgtaactccagatacttggggggcatagagaggaggatcacttgaacctgagaggcagaagttgcagacagctgagatcctgccactgcattccagcctgggtggcagagcaagactgtacaaaaaaatgccaattctatatgtagcttataaaattgggtaaaacaacaaaacttacctttctctttctatgtggtatttccaaaatttaaaactattttaaatctcactgggcccaatctatttttattgctaatgtaccactgctaaaacgatataaacaccttttcttacaggtgcaggcactcatgtagaaaaattgagcatgtggaactgtaagggccagttttgagagataaaattagtttagccccttcaaataaaggacaggcacacatgcctaaacagctgacaaaataagaaactttgcctcctgggttctttccattcatcctaatataaagaattacctactctccataaaattaaaaaagaattacttacaggatattaagatacttaagtgacaaagcctcctgggtagagtgctccaagttatgaaatttttacagatacatatagaaagctgttttaaatcagcgatcttagtacaaattactaaaaagactacacaccaaaaaactttgtggaataacagaagtgtctaaattccttaacttaaatggttttaataaaatgtttgtgtttcacataactaattactatagtttgtaactaaaaccaaaattatgctagcttaacacacagaagttgttataagaaaaacttcagccaaattaaacttcaaagaatattgagcaataaataatttgcaaattggtctgcctcctgagccagagtagactcagagactcagtgaagctgtgtggtggaagaaggtttatggacagaaaaaggaaagtgatatacaaaaaattgaaatgaggtacagaaacacctggattggttacagttcaatgtttgctttatttgaacatggtttctacatttgattagccaaatctcagtgattggcacaaatgtaggctacagtctgtttacaagtttacttgttatagttcaaggacagggaaatctttggcctaaacatttaggccaaacttaacatttgtagggaggcagctttaggttaaacttaacaatttccctctttggtcatcttctcaattttgagagactgacaaaaatttagtcattgatgtcactattagtatgtacttacttggtcttgaaacccactgggaagtgggttttgtaaggtgggagcagttggttttgtaaggtgggaacaaggacttgggattattttattttatttttatttttgtaagggttatagtagagggtacctccttatgctggaacatctttttatatgagaaaaaaacaaaacctgatccattctaggatctgtgtgtttccttaaagtcttagtttatgtcatgagtgactcagtttggtttggtctggtctgttgaggcctgatgcatgagctgagtccaaaaaaatggcctctcataactttgtttaaaaattctccccttttggtcaggttctcacttaggtgatttagactgtgaccaaaacttagggtctgagtgccactcttagttgccatcactttggatttctggtctcagcatgccatttataggttacagtgtcctcatggtcacacatattttgtttcagctcttgtcattccagttgaagagagatcatttgacattccagagatggctgcatggaaacattcaaaattttaaagagaatacagtgtaccaggaagactattattactatcagaaagataataacaagattttggagtagttccttacttagtgtcctcataaaccaaaccactgaaaatcaaaagaatgagctaaagagtctgcttgattaactaagcagtctcttcattaaaactctacaaatccatataatacctggtgtgatgtatttctctgtaggccacacatgccagcagctgcacagataatttctctgtttagccagtaagtaatctagagcaattctatcattgagcataactttcccaagataaagtctgttgtgtaactttagcctttacagtagaatctgctataacacctatcattagggatacatttgtaatcattccctcttgtacttcaaaccatggagaaaatagggcttaacaaatgatgcccttctagaagagtgaaggcctcctctcaatgctctcttaaacccatgatgtaggttaagaggagtgaacaaatattctgtttctgactgattatgaggcaacatacgtaccattaaaatttctcacatttggcctctatcttccatcaaagaataaggttatccagatgtgagggtaatctggctgtgacatctgtcactcagttgatctccagggttgatttggctgatctggctggccaggcacactttcccttcctccctcaccactccatgtgcatccctcctgaagctgcatgctcagtccaagaggatgaccatctctgttagaggaggaccattctttggtcaagggtatacgagtagctgcactcccctggtagaacttccaaacaagctttcaagttataaagttgtatatgtataagactagctacaaaatctatcacaaaagtatatcccatgagtgtgcacaacagaccccccctttcacatctattgttcataaaggcataagcaagggaaaaaaatattcagaatctaatgttagcagagcagtctttatccgttgttcacatcaagtttgccatcttctggggagaaacttttctggttagctttaccttaagggttatagtgggtgtacagtttcaagactgtggagggacccttcttagttgtaagattatgaacccagagttcaaggttccaaagcttttctgtagtgtggatgtcaagggcagtctttctctgatgttctcagaagatccaatctataggctctagattatgaagaggtgttgatctcagtgaatcataaaaaagctttttttacctggtgaaaatacactgtggcataataatctgttataacatcagctctcttgcatgggaaagctttaatacaaccagaaaacacgcactgaaaatgataattcaatgaaatccctttataaatgtttaaatggcccatcaggtagtggattgtatctgaagctttcattgtccttccaggaatatgagtttgacaaaccaaacattggtcataagctattttagcaatttagaattcaccacaccaatatatatttaacttggatcattttatcttttctatgataagtcatggaatgcagaacttttaataatgaaagctttaaggatggactcaggaaggataaggcagctgtcctggttctccatgagtccatgcttaacattgaacttatgtagtcttgaattccagttgtttctccaatttaggtttatagcagtaacaactgaagggttgtcataggtaatttgacttagaccaaggcgttcattcaaactgtgtatttaaacaatttcagtattggttaatttagcgtgaaagtctgacaatgtgttttcttggtattcagttaattttcgttctacttttaaaaacaagtaagtcttttcgttaaagttccaggtactctgacacagtccaaatgatatgattctaaaatttccagaaatctgtattcaagagctcttttcagggtctttccatcctttcaggaatctcccaaaagacaccatattctgggacattttgggcttgtgaagttttcagaaactgcatcagtattaagcaattaactgtggaaatgatgttaaatagtcatagttacccaattaacaggaaaatttggttatttctgtggtctacaatttatcatgataaccataattataattcatagcatatgtttatacatattagaattttagaaattccatataattttggaacatatattaacattcattagaatataacctgaataaggttaaacatttcttattttgacagtgtttcccatgtaacttaatgtgtcaaataatcctgtttacccctgttttgaattcttcagggccctctgtagcatcccaaagttagaagtcaaaaagacttaattttgaaactgaaatttgattttgggaagcccataaaatatattaaaggtttaaaacacttgatattataaagtggaattccagatcacaatgtcattcatttagccaaaatgataactcaaaaaatgtttaaaggcaaaaacccttactcattgatagatgacttagcttttcaagcaatctgtctttcccctctttttcctgtagtttatttggaggggaaaaagacatcttttattatcctttagtattacatgaaaatcttattcaaaagagaaagccaaatttcatccttgcattagtgtactattaaagtcaactccaatttttagtaaaaccttatagacaaatttatccagtctttatcagtttgaccataaggtgagattctcaaaaacttctgataatgttttacaaatttgcattaaagagcagatgagtgctctaagaaaaccctgttttgatttcattccaatgttcaatttatggaaaagctgaataatactcctttaaatttaaccaatatgttcacacacagtatttctcttacaagattatttttttcacaaaccttccacaacttgctcaaacttttagctttattttatctaaattaaaacaatcctttaactctctaaattaggcaaaaatttacattttaatgccttcttataatcttttactgaaagcacatttcactttcctcacacagcttccatagataacttttttcagtagtctgaattacatgttacaatgttaacccttagcaatttttatttttggtgaaaaatctggcaagtaagtgactttaattatgtactaggtgtggagcctaggacaccagacagaagtgcagataaagtctgaccctttcaagcatagccaggggcatggctaactccacatgtccccaggcattacctagaatctaatggctccagagcaggtaaactgaacagattttaaaactcaaggaagcagtttattactttaaagcattttacagacctaatatctgacctgcctaatttagaccaaatgtctttattttaccaataaactttaaagctatctttattttcaaagcttactaaagtcatgtgaactaaaaggcattacagtttttatttctctgaaaaaaatttgatttaagcactcattgtttttaagccaattagagcttttttatttataaacatcacacacaacacatacacagaagtagacccagtagttgtaagacttttcatttgccagtttttaagtttcttagttggattactagcttcagggtggagtcccctgaggaagaaggctaggaaaatatgcagtttctaggacctaataaacaggcacaactgaaaggcaaaacagatccccaaaaatttagggtcccattttatactggatccccaaagagaaatgctatggagcaggacagttcaatgatccttaccatgcattttgttgcagagcaatagaaagccaattagttcattttgtgatcagcccatccctatgggagccttatttctcagtggtgggggaacattgtcatactttctaggtaatcgagaatgtgcttctctgattgagatgtgcaaagagctgaatatccccccataactgccatttgccatcccccaaaaatatatttagccttagactttgtgaggaatctatctgctttcaattcctgggatttcatgaggaaaacaggtttttcccaaaatggggtctgtggtgcctcctctgtttttcccaaggagtcccaggctgttagaaattaatcttatgtcctctcatgcatgcatcaagtttggcaagccaaaatggagaaaaacaattgagttgactgaagagaaaaaagagatccaagaagagaaaaaatcatgaaggacttttaaatacacctatatctttgatatcctattttaattaagctgacttttaactatagtgctctttaaaaaaatcgttttaaatctcttattacctgactttacctaggccaaacagccaatatttctggcttttgaacttttacaaaattaatctcccaggtgaaaccaataagtcataactaaggttatgacttaaccacgagtgatgaggtattttcaaagaggtagtaagcaatttttacaaaatctaaaatctccaaaaatagcttagagaaagaaaaattcaagatggatgtcagaagttgtttatggagagaaagagaatcaataaatggcaaaggtcacacagatatcaaaccagaaaggactgattccctgagccaagaattgaaaccaggttgccgttgtaaaaaggcaaaaccttagccactaagccacagtattgggtagtttccattgttcttcccagaaggagcctagagcagctgattttgaacttgcagaggcttttaactgctcaagataatttttagaactatgacatgaactctaaaattcctgccctccagatggtggagaccaaggaaagtactaccatgtggtaacaaggtcaagctcccaaggacataaaactagatgagagggaaacctcatctttatttatatatttatttatttatctttttttttaatgtttcaggaagctgcagcaaagtttgtaaatgaccagtttgctgggctggcttgaacttcgagcttttgggggtcctaggcctgcattctatccaatggtacccccacagaccaattggtagcacaaagtacaccaggtttgccatagtttaagactagtcacacatatccttgttttcattatttaaaactttgcagaggagactgatttttaccatttctacaactagttcacacacacacacacacacacacagaggccagaagtctgaggatacccttttggaggcatgtcaggcttctgggcttcctttcccttagtgttcctagcaaccctgctcactgcaccatagcctggggggcctaactttttctattttataaaaccataggtataggtgaatttaaaatgttctggttgagaattggtggagtttgtctaaagacctgggattcatagaaagggaatattcaggttaagataaaggttgtggagaccaaatttcttttgaagtcttatagtggctgccctgcccttagagacaatagatgacaaatgttttctattcagatttagttaatctctttacatttgggggggtctggaagaaaatgatccagctatattaatagagattctttacagatgtaaattctcccctacaaataacaggtttgcagggccatttcaagatatggcaaagaaatatgttttgggataaaatattttgattttcttccttgtctcataatgttatgccagagtcaggttggaaaataagtcatgacatacaagtttaaataaaacccttctgatgggaatttacgttttgtaggacatgactacccagaccctttagataggaatttggacaagataaaattagagtttagccctcaaacatttaaactggctataagccttttggctttaagtctgttggtcatagcagccccaccaaggaacagaatgattccagggcagggagctgcaccaccctgacaacagggacaaaattaaactttgacttttttgtttgtttgtttttctgggacagagtcttgctctgttgcttaggctggagtgcagtggcatgatcttaactccctacaacctctgcttcccgggttccaacatttctcctgcgtcagcctcccaagtagctgtgattacagatgcccaccaccacacctgactaattcttgtgttttttgtagagacagggttttgccatgttggccaggctggtcttgaactactggtctcaagagatccacctgcctcagcctcccaaagtgttgggattacaggtgtgagccactaagcccagccaaagtttgactattgatgttgccttgcaaatatttgccagaaagagcaggatgtaaaccacaaataaaattctaagttccccaactgactaagtggacctctcagccaaggaggaccaaacaaacctgaaacactagctcaggccatgatgggaagtgaggatagacatgcctcattgtacccttctatccttggacttgaggcccgagtaaacagtattaacattacaattataactgacataacagactctgtaacaataagaccagctccaacctgactgtggtataacttcacatgacaaataacaggccctaaaagaaaaagtattgtaagccaaaatatattactttgacatattttgaaatggccctgcatgtctgtctcttggggaaatttgcattctctaaagaatctccctccctcactaggtctctccagagagtctgacacctctgataagagatattcatatctattctctctgaaacctgctatctagaggcttcatctacaagagaagaaccttggattctgcaaccttccccccttaactgaagctgattccaactaggtgatactaatttacattgcaaacaatactgtttatgcattcacttttttctggatcctcaccaacattttttttttctttttaaattttaaaaatagccattcaaactggtgttaagatgatatcttactgcagcttaaatttgcatttctctgaagattagtgatgagcatcttttcataagcttgctgcccacttgtatgtcatcttttgataaatatctgattatgtcctttgcctactttttaatgttttttgttgttgttgttaagttccctatagatattagatattacttctttgtcaaatgcataatttgcaagtatttcctcccattgttcaggtagtctgtttgctgtggtaattatttcttttgctgtgcagaagctctttgtttaatataatcccatttgtgtattttttactgttgtttcattgacttagttataaattctttgcataggccaatgtcctgaagaggttttttaggttttcttttagaatttttatagtttccagtcttaaatttaagtctttaatccattttctgttaatttttgtatatggtgggtatagggattcagttttattcttctacacgtggctgtttaatttattttaggacaagttatatagattgttttttctatacatatgtacatatgagggccctggtctgttccattatcctatgggtataattctgtaccatcatcatgctgttttggttactacagtcttgtagtgtaatttgaaatcaggtaatagggtgccttcatctatgttatttttgcttaggctttttttttcattccatgtgaatcttaaattattttactaattctttgaaaaatgatggtaatagtttgaccagaatgcattgaatttgtatattgccttggacagtatggtcgttttaatgacattgattctttcaaatccatggttataggatattttttacatgtttgtttcatctatgatttctttcatcagtgttttgtctttgcctggagtgtagttctcctaacacagatcttccacctccttgactaaaatgaacttctaggtatttcatgtttgtgtggctattgtaaataagattgagtccttgatttggttttcagcttgaacattaatgatgtatagaaatgatacttctttttgcacatttattttgtatcctgaaacattactgaagtcatttatcaagtctaggagtttcttgtaggagtctttagggtttaccaggtataagatcaataagcaaacagagataatctgactttctcttttccaatttggatgccttttatttctttcccttgcttacttgcttagtctaggacttccagtagtatcttgaataggagtggtaaaatttggtatccatatcatgttccagttcttagggagaatgcttttaacttttgcccataaatatgatgtagggtgtgggttcagcatatgtgacatttttttgagaaatgttccttcaatggcttgttttttgagaatttttatcatgaagggatattggattttatccaatactttttctgcatctattgggatgatcttatggtttttcttcttagttctctgtgtggtgaatcacatttattgatttgcatatgttgaaccatccttgcatcccttttttttttaatttctgtgttaattttttttttgtttacccaaagatcattcagaaatggtgtttagtttccatatatttgtgtagttttgaggtttcctcttggtattgatttctaattttattcaaaattagaataagattactgtagtctgagaagatatctgatatgattttggtctttttaaatttggtttaaagttcattttaagtgaagactttccttgtggatttttatcctcgatgatttgtctactgctgtcaatgggtgttgaagtgccctgctattactgtattgctgtctatgtctttccttcagtctatttgtatgtggttaatgaacctaggtttccagtttggggtgtatatattttaagaatagttatatctttttgttgaattgttgaattgaatcctttatcattatgtaataaccacctttttttcccactgttcttaatttaacatctgtattatctgataaaagtacaactgcttctgctcattttcattttctgtttgcatggtacacctttatccaccccttgactttcagtctaagtgtgtttattcactaggtgattctcttcttggcagcaaatggatgaatcttgttgtcttacattcaatttgccattctctatcttttaagtggagcacttaggccatgtacattcaaggttttcattgatacttgagattttgttcctgtcatagtgttgttacctagtttcttcagagtctcaattgtgtcatcatattgttacctagtttctttggagtctcaaccacttcataggatttgtgaggtttgtactgatatgttttttaaaattttaacaattatttatttatatatttgtgtgagacattgtctcactctgtcacccaggctggagtgcagtggcatgatcttggctcactgcaacctccacctcctgggttcaagcgattctcctgcctcagtctcttgagtagctaagattacagacatgtgccaccacacctggctaatttttttttgtatttttagtagagatgtggtttcatcatgttggccagactgggctcaaacccctgacctcaaatgatccacccaccccagcctcccaaagcactgggattacaggccactgctcctggctaacaatgatttttgatgcagaggtacatgtgcttgatcattgcaagggtatattgcacccagttagtcagaatagtactcagtaggtagtttatcaatccatattcctctttcttcctcctcactctagtagtatatatattttattcccatgtttatgtctcagtgtggtgaatgtttagctttcactcataagtgagaacatgtggcattttattttctgtttctgtgttaatttgcttaagattatagcctccagttttatccatgttgctgataagaacatgattttattccttttatggttgtgtagtattccatggtgtatatggaccacaatttctttttttttgtttaattatactttaagttttagggtacatgtgcacattgtgcaggttagttacatatgtatacatgtgccatgctggtgcgctgcacccactaacttgtcatctagcattaggtacatctcccgatgctttccctcctccctccccacaccccacaacagtccacagagtgtgatattccccttcctgtgtccatgtgatctcattgttcaattcccacctatgagtgagaatatgccgtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtcgtaataaacatacgtgtgcatgtgtctttatagcagcatgatttatagtcctttgggtatatacccaggaatgggatggctgggtcaaatggtatttccagttctagatccctgaggaatcgccacactgacttccacaatggttgaactagtttacagtcccaccaacagtgtaaaagtgttcctattactccacatcctctccagcacctgttgtgtcctgactttttaatgattgccattctaactggtgtgagatgatatctcattgtggttttgatttgcatttctctgaaggccagtgatggtgagcattttttcatgtgttttttggctgcataactgtcttcttttgagaagtgtctgttcatgtccttcgcccactttctgatggggttgtttgtttttttcttgtaaatttgttggagttcattgtagattctggatattagccttttttcagataagtaggttgtgacaattttctcccattttgtaggttgcctgttcactctgacggtagtttcttttgctgtgcagaagctctttagtttaattagatcccatttgtcaattttggcttttgttgccattgcttttggtgttttagacatgaagtccttgcctatgcctatgtcctgaatggtaatgcctaggttttcttcaagggtttttatggttttaggtctaacctttaagtctttaatccatcttgaattgattttcatataaggtgtaaggaagggatccagtttctgctttctacatatggctagccagttttcccagaaccatttattaaatagggactcctttccccattgcttgtttttgtcaggtttgtcaaagatcagatagttgtagatatgcggcattatttctgagggctctgttatgctccactgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagcagttttttccaattctgtgaagaaagtcattggtaacttgatgggggtggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacataccttgtaagttggattcctaggtattttattctctttgaagcaattgtgaatgggagttcaccatgatttggctctctatctgtgtgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgaataccctttatttccttctcctgcctaattgccctggccagaacttccaacactatgttgaataggagtggtgagagagggcatccctgtcttgtgccagttttcaaagggaaagcttccagtttttgcccattcagtatgatatcggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcctacttgatcatggtggataagctttttgatgtgctgctgaattcgttttgccagtattttattgataatttttgcatcgatgttcatcaaggatattggtctaacattctcttttttggttgtgtctctgcccggctttggtatcagaatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattctacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctgtttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaatcgtgatgttagggtgtcaattttggatctttcctgctttctcttgtgggcatttagtgctataaatttccctctacacactgctttggatgcatcccagagattctggtatgttgtgtctttgttctcgttggtttcaaagaacatctttatttctgccttcatttcgttatgtacccagcagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtacgtggtcaattttggaataggtgtggtgtggtgccgaagaaaatgtatattctgttgatttggggtggagagtcctgtagatgtctattaggtctgcttggtgcagagctgagttcaattcctgggtatccttgttgactttctgtctcattgatcggtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccatccttttattttgagcctatgtgtgtctccgcacatgagatgggtttcctgaatacagaacactgatgggtcttgactctttatccaattttccagtctgtgtcttttaattggagcatttagtctatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtttagcgcttccttcaggagctcttttagggcaggcctggtggtgacaaaatctctcagcatttgcttgtctgtaaagtattttatttctccttcacttatgaagcttagtttggctagatatgaaattctgggttgaaaattcttttcttgaataatgttgaatattggcccttactctcttctggcttgtagagtgtctgctgagagatccgctgttagtctgatgggcttccctttgagggtaatccgacctttctctctggctgcccttaacattttttccttcatttcaactttggtgaatctgacaattatgtgtcttggagttgctcttctcgaggagtatctttgtggtgatctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgattgcatcagctcctgaggcttctgcattcttcacatagttctcgagcttaggttttcggctccatcacctcctttaagcacttctctgtattggttattctagttatacattcttctaaaaatttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccgtctttgtggttttatctacttttggtctttgatgatggtgatgtacagatgggtttttggtgtggatgtcctttctgtttgttagttttccttctaacagagaggaccctcagctgcaggtctgttggagtaccctaccatgtgaggtgtcagtgtgccctgctggggggtggctctcagttaggctgctcgggggtcaggggtcagggacccacttgaggaggcagtctgcctgttctcacatctccagctgcatgctgggagaaccactgctctcttcaaagctgtcagacggggacatttaagtctgcagaggttactgctgtctttttgtctgtctgtgccctgcccccagagatggagcctacagaggcaggcaggcctccttgagctgtggtgggctccacccagttcgagcttcctggctgctttgtttacctacgcaagcctgggcaatggtgggtgcccttcccccagcctcactgccaccttgcagtttgatctcagactgctgtgctagcaatcagcgagactctgtgggcgtaggaccctctgagccaggtgcgggatataatctcgtggtgcgccgttttttaagtccatgggaaaagcacagtattcgggtgggagtgacctgattttccaggtgccatccatcacccctttctttgactcagaaagggaactccctgaccccttgtgcttcccaagtgaggccatgcctcaccctgcttcggctcgtgcatggtgtgtgcacccactgacctgtgcccactgtctggcactccctagtgagatgaacccggtatctcagatggaaatgcagaaattacccgttttctgcgtcgctcatgctgggagctgtagaccggaggtgttcctatttggccatcttggctccttggatccacattttgtttatccaatctactgttgatgggtacttggtttgattttccatggctttgctattgtgaatagcacagtaataaacatatgagcacaagtaggttttggtataataacttattttcttttgggtatattcccagtaatgggattcctgggtctaatggtctctctgttttaaattatttgagatgtctcaaaactgcctttcccaccaacagtgcataaacattcccttttctccacagccccaccagcatctgttgttttttgagtttttggtaatagccatactgactggtgtgtgatggtatttattgtggttttgatttggatttgtcttatgattactgatgctgagcagttttttatatatttttggccacttgtatgtgctttatgatgttatgattcttttgtttccatgtttagaattcttttgagcatttcttgtagggttggtgtagtggtgacacattcacttaacatttgcctgactttgaaatactttatctctccttcatttggcaggatataaaatttggggctggcatttttgctttaagaaggcttaaataggtctttaatttactggtctgtagactgtctgctgagaaatctgctgttagtccaatgggatttactttatagatgatttgatgcttttctctacgtgctcttaagatttttttcatgttgactttggataggcagatgactgcatgccttggtgatgttcaccttgtaaagtatcttctagttattctctgagcatcttgcatttgcatgcctacatctttatcaagaccatgaaaactttcctaaagtgtctcctcaaatacgttttccaagcctttaacattttctccctcaggcatgcttataactggtgggtttggtcactttacgtaatcccatattttccaaaggctttgttcatttttgaaaattcttctcttatttttatgtgagtaggtgaatttgaaagaccactctttatgttctaaaattgtttcttgtgcttgatcctaggacagtgtgaaaacctttgactgtatttaacttttcattttcagaatttctgctttttcaaatttgtctttccttttacattttaaactgtttttggtgttttgattttttttaaaattttaacttttattttaaattcaggggtacatgtgcaggatgtgcaggtttgttatatagataaacatataccatgttggtttgctgcacagatcatcccaccactcaggtattaagcccagaatccattagctatttttcctaatcctctccctttttccaccccctgccctcctacaggttccagtgtgtccccctgcccaatgtgtttccatgtgttctcataatctatctcccacttagaagtgagaacatgcagtatttggttttctgttcccacattagattgctaaggacactcacctccagttccatccatgtctctgcaaaggacatgatctctttccttttatggctgcatagtatgccatggtgcatacttaacatattttcttcatttaatctgtcattgatgggcgtatatgtttcttccacacctttgctattgtgaatagtgcttcaatgaacgtgtgcgtgcatgtgtttttataatagaacaatttatattcctttgggtatatacccagtaatgggattgctggtttgaatggtatttttgcctctagacctttgaggaatccccacactgtcttttaaaatggttgaactaattcatactcccactatcagtggaaaatcatgcctttttcttcacaacctcaccagcatctgttgtttttttgacttttaaatcatagccattctgactggtgtgagattgtatctcactgtggttttgatttgcatttctctaataattagtgattttttttcatatgtttgttggccacatgtatgttttctttttttttttttttttttttttgagacggagtcttgctctgtcgcccaggctggagtgcagtgacgcaatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatgttttcttttgagaagtgtctttgcccacttttgaatggggttgtatggtttttttctgataaatttgtttaagtttcttatagatcctggatattagacctttgtcagatgggtagattgcaaaattttttttcccattctgtaggtttcctgtttactctgttgatagtttcttttgttgtgcagaagctctttagtttaattagatcctatttttcaattttgcttttgttgcaattgcttttttgtcttcatcctgaagtctttgctcatgcctatttcctgaatgatattgcctaggttttcttctggagtttttacagtgtttggtttttcatttaagtctttaatattgagttgaatttgtatatggtggaaggaaatattacagtttcaattatctgcatatggctagccagttctcctagcactatttgttaaatagggaattctttccccattgcgcattcttgttaagtttgtcaaagatcagatggtggtaggtgtgtggtcttatttctgggttctttattctgttcttttggtctatgtgtctgttcttgtactagtaccatgctattttggttactgtagctctgtagtacagtttgcattcaggtagtttgatgcctcgagctcttttttttttttttctttttacttgggattgccttggttattcaggctcttttttggtttcatattaattttaaaatagttttttctaattctgtgaagaatgtcagtagtagtttaatgggaatagcattgaatctgtaaattgctttgggcagcatattagtctgtttacacactgccatatagaactacctgagacatagtaatttataaaaaaagaggtttaattgattcacagttatgcatggctggggaggccttaggagacttatgattatggcagaagctgaaggggaagcgaggcacatcttatctagtggcaggaggtagatagcaagggggagactggccatacacttttaaaccattagaccttgttagaactcactatcatgagaacagcatgggaaaaaccactctcatgatccagttacttcctactaggtccctttcttggcatgtgggaattacaactggacatgagatttgggtggggacatagagccaaaccttattatttaactcctggattctcctaaatctcatgtccttctcatgttttgaaaccaatcacaccttccaaacagtcccccagcctcttaatttattccaacattaactcaaacgttcaagcccaaagtctcatgtgacactatgcaagttcctatcacctatgagcctgtaaaataaaaaaaatttagtgatttcttagatacaatgggagtacaagcattgggtaaatgctcccattccaaatgcaagaaattggccaaaacaaagaagttacaggccccatgcaatccagaacccagcagggcagtcattaaatcttaaaactccaaaataatctccttcaactccatgtctcacatgcaggccacactgacacaatgcatggccttctaaggccttgggcagatcctccccagtgattccacagggtagagcccctgtggctgctttcttgggctagcattgagtgcctgtggcttttccaggtgcatggtgcaagctctcagtggatctatcatcctaggttctggagcatggtggccctcttctcatggctccaccaggcagtgccccagtgggcactctgtgtggggccttcaaccccacatttcccctctgcactgccctagtagaggttctccatgacggctttgcccctgcagcagacttctgcctggacatccaggcgtttccatacatcctctgaaatctaggcataggctcccaaactgttgccttctgtgcacccacaggctcaacagcatgtagaagccaccaagacttgggacttgcatcctctgaaactactgtctgagctgtaccttggcctcttttagtcacagctggagctggagcagctgggacacagggcaccatatcccaaagctgcacagaccagcaaggtcctcggcccagcccacaaaagtatttttctctcctaagccttcaggcctttgatgggagtggctgccataaagatctttgaaatgccctggagacattttccccattttcttggttattaacattcaccttctctttacttatggaaatttctacaggcagcagcttgaatatttccccagaaaatccatttttgttttctaacacatggtcaggttgcaagttttccaaacttttatgctgttttcctttaaaacataagttccaatttcagaccatccctgtgaacacacatgactgtacacattcagaaacagccaggtaatgtcttgaatgatttgctgagctgcttagaaatttcttcttcaatgggcaccatggatcatgcctgtaatttcagcactttgggaggccaaggtggggatgacttgaggtcaggaatttgagaacagtctggtcaacatggtgaaaccccatctttacaaatcatacaaaaattagctgggtgtggtttcatgtgcctgtatttccagctactcaggaggctgagacatgagaattgcttgaatccaggaagcagaggttgcagtgggccatgatcacaccactgtactctagcctgggtgacagagcagaactctctcagaaaaaaaatttgttctgcaagataccctaaatcatctctctgaagttcaaagttccacagttctctagtttaggggcaaaatgctgccagtctctttgcttaagcatagcaagagtgacctttactttacatcccaataagctcctcacttccatctgagttcacctcagcctggacttcattgtccatatcactatcagtattttggtcaaatccattcaaaagtttgtaggaagtcccaaactttccccaatattcctgtcttcttttgagccttccaaactgctccaacctctgctcattacccagtttctatgttgcttccacatgttcaggtacctttatagcagtgccttactcccagtatcacttttttgtattagtctgctttcacacagctataaagaactacctgagcctgggtaattcataaagaaaagatgttttgttgactcgcagtgacacacatctggggaagcctcaagaaatgtacaatcgtggcagaaggtgaagagaagcaaggcacattttacacagtggcaagagagtgaggggggaactgccacacacgtttagtccatcagatctcatgagaactcagtatcatgcaaacagcatgcgggggtgcgggttgctcccatgataaaattaccttgcaccaagttccaatctccatgtagggattacaattcgatttgagatttgggcatgaacatagagccaaaccatatcaggtagtatggccattttgatgatattgattctttatccatgagcatgaaatgtttttccactcgtttgtgtcctctctggttttcttgagtagtgttttgtagttcctgaagaggttcttcacttttcttgttagctgtattcttaggtattttcttgtgtggcagttgtgaaggagaattcatttactatttggctcttggcttgcctcttggtgtataggaatgctggtgatttttgtacattgattttgagttctgagactctgctgaagtggcttttcagtttcttctgtgaagttattgggctgatatgatggggttctgttgaaataggaatagaatcatgtcatctgcaaacaaagatagtttgacttcttctctttttatttgaatatgcttaatttctttcttttgcttgattgccctggccagaacttccaatactgtgttgaataggagtggtgagagagggaaactttctcttatgccaattttcaagggaaatgcttcttctttttcttcttcttcttcttcttcttcttcttcttcttcttcttcttcttcttcttcttcttcttcttcttcttcttcttcttttttttgagacagagatttgttcttgttgcccaggctggagtacaatggtgctatctcagctcactgaaacctctgcctccagggttcaggagattctcctgcctcagcatcctggtgttttgggtagctgggattacaggcatgaggcaccatgcctggctaattttgtatttttagtacagatggggtttctccatgttggtcaggctggtctcaaactcttgacctcaggtgatccacccacctcggcctcccaaaatgctgggattacaggcccgagccactgcacctggccctcaaggcgtcaagatagaataagcttctatcttttgcttattcaacatgatatttgctgtgtgtttgtcatatatggcttttattattttgaggtttgttctttcaatacctgtttattgagagtttttaaaatgaaaggatgttgaattttgtcaatggcattttatgcccctattgagataatcatgtggttttgtctctagttctgtttatgtgatgaatcacatttgatttgcatgtgttgagccagccttgcatcctgggaataacttctgcctgattatgtgttgcgggaagtcagggaccccaaacagagagactggctgaagccatggcagaagaacataaattgtgaatatttcatggacattgattagttcctcaaattaatacttttataatttcttacacctgtctttactgcaatctctgaacataaattgtgaagatttcatggacatttatcccttccccaatccatactcttgtgatttcctatgcctgtctttactttaatctcttaatcctgacatctttgtaagctgagtatgaatgatgcctcaggatcctgtgatgattgcgttaactgcacaaattgtttgtagagcacgtgtatttgaatgatatgaaatctgtgcaccttaagaacaggataaccacgattttcagggaacaagggagatgaccttaaagtctggctgcctgtgggcaggaaggacagagccatatttctcttactaccaaaaatgggtaagataaatgtcactgaactctttccccagtaaggaatattaataattaacagccctgggaaaagaatgcattcacagaggaggcctctgaagtggccgctctgggggtgtctgctttatgcagatgtagatagggatgaaacatgccctcgtctcctgcagtgcccccaggcttgctaggattaggaaattccagcctggtgaattctagtcagaccagttctctgctcttgaagcctgacaatgcgtgcacagtgggacatagaagttcattagtgattctagtttcaccctgaccttctgccttgtgatcttttgttgcccttgaagcatgtgatctctgtgacccacaccctatttgtgcactccctcccctttgaaaattcctaataaaaacttgctggttttacagctcaggggcatcatggaacctaccgacatgtgatgtctccctgggcccccagctttaaaatttctccttttgtactctgtccctttatttctcagactggctgacaattagggaaaatagaatagaacctacatgaaatattgggggtgaattttgcccaataattatggtggataggctttttgctgtggtggataagctttttgctgtgctgatggattcagtttgccagtattttgttggggatttttgcattgatgttcatcaagaatattggactgaagttttcttttcttgctatatctctgccagggtttggtatgttggcctcatagaatgagttatggaggagtccctcctttttaatgttttggaatagtttcagtaggaatggtaccagctcttctttgtacctctggtagtattaagctgtgaattcgtctgttcctgggctttgtttttggtttgtagagtattttttactgtctcaagttcataactcattattggtctattcaggattcagtttctccgtgcttcagtcttcagagcatgtatgtgtccagcattttatccatttcttctcaattttctagtttatgtgcatagaggtttttgtagtattctctgatatttgtatttctttggggtcagtggtgatacacttcttattatttctggttttgtctacttgaatttttctctcttttcttcattagtctagctagtagtctctattttaataatttttttcaaaaagccaacttctggatatgctgatttttgttaagggtttttcgtgtctctatctctttctgttctgccctgatcttgactacttcttgccttctgctagctgaggggtttgtttgctcttggttctctagttattttagttgttatttatgttattaacttgagatctttctagctgtttgatatgggcattttagtgctacaactttccctcttaacactgctttagctgcatcaaggagattcccagatgtgttgtatattctcattagtttgaaagaacttcttgatttctgccttaagtttattatttactcattcagaagcaggtggttcaacttccatgtagttatatggttttgcatgtatttcttaatcttgagttctaatttgattgtgctgttctctgagagactgtttattattatttcagttcttttgcatttgctgaggagtgttttactttcaattatatggtcaattttatactaagtgccaagtggtgatgagaaggatgtatattctgttgtttgggtgtggtgagttctgtacctatcaggttcacttgattcagagctgagttcaggccctgaatatgtttcttaattttctgtcttgatgatctgtctaatattgtcagtggggtgttaaagtctctcactattattgcctgggagtctaagtctgtttgtaggtctctaagaacttgttttatgaatctgggtgctcttgtactgggttcatagatattccagatagttagctcttcttgttgaattgagccctttaccattatgtgatgcccttctctgccttttggatctttgtttgtttaaagtctgttttttcagaaactaggattgcaacacctgctttttgtttggtaaattttcctccatccctttattttgagcttatgtgtgtctttgcacatgggatgggtctctggaaggcagcataccatttgttcttggttttttatacagcttgctattctgtgtcttttaattggggcatttagcccatttacatttaaggttagaattattatttgtggatttgatcctgtcatcatgatcctgcctggttattttgtagacctgtttatgtggtctacagtgtcacttcatagtgacactggtctgtgtacttcagtgtgtttttatagtggctggtaatggtttttcctttccatattcagtgctttcttcaggagctcttgtaagtcaggtctgctggtaacgaattacctcagcattagtttgtttgaaaaggatcttatatcttctttgcttataaagcttagtttggccagatatgaaattctgggttggaaattcttttaagagtgctgaatagtggccttcaatctattctggcctttaaggtttctgctgagaggtccactatttgtctgctgggcttccctctgtaggcgatgtggcctttctctctggctgccctgagcattttttccttcatgtggaccttggagaatctgctgattatgtgtcttgaggacgatttttttttgtggattatcttactggggttctctgcatttttgaaatttgaatgttggcctgtctaggtagatcagggaagttctcctcgatggtatcccgaaatgttttccaaattggttttactctcctcatctctttcatgtacctcagtcagttgtagattcagtctctacataaccccatatttctgtgaagttttgttcattcctttgttctttgtttttattcttgcctgcctgtcttatttcagaaggtcagtcttcaagctctgagattcttccctttgtatggtgtattctgctactagtacttgtgattgcattatggagtttgttagtgtgtttttccgctctatcaggtcagttatgtttctctctatgctggctatcagctcttgcattattttatcaagattcctagcttccttacaaggggttgcaagtggcttttttagctcagtgcagttcatttttacccacattggaagcctacttgtgtcatttcagctatttctagcctcagtccagttctgaatccttgctggagaggtggtgttgtggccatttggagaaaagggggcactctgggtttttgaatttttattatttttgcactgattctttctcatctttgtggacttatctacctttgatctttgaggttcctgatcttaggttttttttttttttttttggatgtttatttgcttgggtgcttttctttcagcagtctggccactgtttcataggggtgctgcagtttgttggggttccattctagacccttgttgcctcagtttttccagtacctggaagtatcaccagagaaggctgtgaaacagcaaagatggcatcctgctccttcctctggtagcttcattccagggggcctgaatgcacctataggagttggctggagacctgggttggaatacctcacccagtcagagggaaagggatcggagacaaacttgaagacgcagtctggctgaattttgtagagcagctgtgctgtattggggatcccttcagcctcccagttggtttggatcctttaaggttcacaggttggaccagctcagatgcccaaataggaaaggtggtggcctgcttcacccatcaggcactccatcccagggataaattagaactttgtttgcaatagaacatgagcagtggtgaccagaggctttggctgggagagccagcaaggaggaatggatctgagtcctgttgaaagaagcagtctggccacttctcaacaaaacagctatatcatgctgtggaattgctttttgccttgtctgcttatactctccaaagcccacaggcttgaagggctgagtcatccaaacagcaaagatgatgacccacccctccccacaagcactttttggcagaaagatatcagaacgctgtccatagtatacaggtgagggtggccagaggccttggctaggaggactgaccttgtgagaaggagtagatcagggacccatttaaagaagcagtctggccatgcctcaacaaaacagtcatgacaggctgtggaaccacctttgccctgttggtgttggactctccctaggcctaaggctggaatggctgagttgtccaaacaaccaaggtggcagcccatcccaaggagagatcagaactctgtctatagaatatgagtgggagggggtggctggagacccaagttgggaggtctcacccagtgaggaagaatggattgaggtttcacttaagcagtctggccacgttctggcaaagcagctgtgctgcactgtgaggaccttttctcatttgtaccatctggactctccaaatcctgctggctggaacagctgggttgaccaaacagcaaagatgatagtgtgccccttgtcttgggggttccatcccatctcaggcaggctccaccctgtttttagtggctggctggaattccaagccaatgggtcttatcttgtgacatgccatggaagtggggcccgcagactgctgctgctcagctccttcaattctgcccccttcctatgggtatgtacggacctttgaccttgcctgagttgcagtcacctttgtcagggatcctgggctcagagtctataaagctcctgggtttctgtgcatgcctgagcagttgctctgccaagactccacacagctgtgtgttggacccaaggcccctgtagtgtgggctcacaaggtaatctgctgattggagggttgcaaagatctgggggagaagtgtggtttccctggggttgcacattgactcactgcttttcttggctgggggtgaggggctccctttccaaattgttaatctgatttctttgtggtggttttcaactctcttgtatctcattgggctttcttacaagccatagtttgccatttgtggaattggtggaatttgtcctttcagaatttttattttgtttaggacccatgtctagaccgctagtgtgatccttatgggtgctgcaacactctgttttttgtgatgccacagttcttattctgattttttttgaatttacttctgttcagatggggattttaccccccgagggtttatttcatatgttgagtagcattttttttggctttgcttctttatgctattagggggcaaagctttgtttgaattccttggtagtagatagcctttgtgtagtggtgttctcaaatgccggttgtttgtagcatgtagtagtggtgtactatgcatgtgagtaggcttgctgtcttctgcagagatgggtaggaggctcatcattttttacagcagtgtgaacttctgtcagcaggaattattttaaattctgccgtccatcctatagaccagtaggtggcacttgtaagagctagctgaatgctgcacagatgtgtcagcataagctgtaatcatttttgcagactggcatcaaagtcagtaggttgtacttgcaagaaagaggcagcttcagtggtggcagtgagatttttacttggccatttaaaaccaggagaagtgccagggtatctcagtgatgggcagggctgtggagctcctggggatccctgtccggttctttgctaccaaggtgactagagtgggcaatgctggtcatggctgggttggtatgtcagtgagcaggctcttgaaggcaggcataagtaccaacgtttgcagcagtctaggcacagctcccaggctgctggagcaactcttaagggaggaatagaggtgtctgtccaccacagagcctactgaggtgaagaagggcatggcccagagtgttcagcatagtaggtggctgtgggatccacctaattcccacacccctgacctgaaagttctccctccaggcgctagctgctgccagaatgccagaatgcttagactggtcccaaagagtctacattcagattgttgaacagttccagaaactgtagctatgaggccacaccctctcaggactagtcttgtgatgaaaggcgggcccagctcctatgccacagcatacattcacacaacagtcttctctgtgttctgtcagtgggaattcctcccctgttggaggtcacataacaaatctcatcttcatgcacctgagtgattgtgttgagtcctggggaactgggataaggtcagtaggtttttcccctggccactcaggctgtagcacctgctgtgatcagaaggggtaaacagcttccaggccaccaaaagaacactcaggtgtggcaacagcaactgtgccacatatctcaacttcctgtgagaatgggaaggcaggcagtcttgggatgaactggcaggcatgggatgtgtggcttgaatgtacttcattcccaacacaatggtggtggaacctgtttagggagcaagagagtgccttgggccccactcattccctggcctgacaggcaacagcagcatcacctcaaaataggatgcaaagccttcagggatgggcaccaaaattgtgctttgctacagcagcccagcacatggaagtccttcatgttttgtttaaatgcatacatttgtttgagggatggagaaggtgtacttatatacctcagcatgtttcatttttctttttatcatgcaaggagttgatttggttcaggcaaatattcattgaagtttaaaatgtacatacctcaccatgcagtaaacacctgtttaatgtctgacctgctcagatttcatttacttgtactgataatgcttttttgttttatttattcataacattttacatatttatcaggtacttgtgattgttacatgcatagaatgtattatcaagccaggagtatttgaggtatccatcaacttgagtgtttgtcatttttgtgttggtaccatttcaagtcttctagctactttgaaatatactctgctatctgaagtcacccaactctgctatcaaacattagaatttatttcttctaactgtatgtttgtatccattaaccagcctctcttcatcctcccttctaccctcacatcttcccagcctcaggtagttatcattctctgtcttcatgagatcaacttttttagctcctccaaatgagtgagaacatacaagatttgtctttctctgcctggcatgtttcacttagcatggtaacctccaggtacatccatgtcattgtaaatgacatcttatttcttcaattactgaataataatccataatgcatatataccacattttctttatctgttttattgatacttctgttgatttcatagctttgctgttgtgaagagtgctataaacaattgagtgctggtatctcttggatatactgttttcttctcttatggataaataccccatagtgggattgctagattgtatgatagttctacttatagcttttaaataaatgtttacgctgtttttcatagtagttgtactaatttacattcccacaaactgtgtaataagcattccctttatccgcatccttgccagtatctgtttttgtttgttgttgtttttgcttgttttgtctttctaatcattttagctggggtaagatgatgtctcattgtggtttcaatttgcatttccctgatgattagtgatgttgagcgttttctatgtaactattggtcattagtatgttttcttttgataattatttatttatttatttattacttttgattatgaatcctcctggaacttgattctttaaaaatttattattattatactttaagttttagggtacatgtacacaatgtgcaggttagttacatatgcatacatgtgtcatgctggtgcactgcacccactaactcgtcatctagcattaggtatatctcccaatgcttcccctccccactccccccaccccacaacagtccccagagtgtgatgttccccttcctgtgtccatgtgttctcattgttcaattcccacctatgagtgagaatatgtggtgtttggttttttgttcttgcgatagtttactgagaatgatgttttccaatttcatccatgtccctacaaaggacatgaattcatccttttttatggctgcatagtattccatggtgtattgtgccacattttcctaatccagtctatcattgttggacatttgggttgcttccaagtctttgctattgtgaataatgccgcaataaacatacgtgtgcatgtgtctttatagcagcatgatttatagtcctttgggtacatacccagtaatgggatggctgggtcaaatggtatttctagttctagatacctaaggaatcaccacactggcttccataagggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctgaaggccagtgatggtgagcattttttcatgtgttttttggctgcataaatgtcttcttttgagaagtgtctgttcatgtccttcacccactttttgatggggttgtttgttttttttcttgtaaacttgtttgagttcattgtagattctggatattagccctttgtcagatgagtaggttgtgacaattttctcccattttgtaagttgcctgttcactctgatggtagtttcttttgctgtgcagaagctctttagtttaattagatcccatttgtcaattttggcttttgttgccattgcttttggtgttttagacatgaagtccttgcctatgcctatgtcctgaatggtaatgtctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccctattgcttgtttttgtcaggtttgtcaaagatcagatagttgtagatatgcagtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggagatgtgggcttttttttggtttcatatgaactttaaagtagtttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttacttccttgagcagtggtttgtagatctccctgaagaggtccttcacatcccttgtaagttggattcctaggtattttattctctttgaagcaattgtgaatgggagttcactcatgatttggctgtcggtctgtctgttgttggtgtataagaatgcttgtgatttctgtacattgattttgtatcctgagactttgctgaagttgcttatcagcttaaggagattttgagctgagacaatggggttttctagatatacaatcatgtcgtctgcaaacagggacaatttgacttcctcttttcctaattgaataccctttatttccttttcctgcctaattgccctggccagaacttccaacactatgttgaataggagtagtgagagagggcattcgtgtcttctaccagttttcaaagggaatgcttccagtttttgcacattcagtatgatatcggctgtgggtttgtcatagacagctcttattattttgagatacgtcctatcaatacctaatttattgagagtttttagcatgaagtgttgttgaattttgtcaaaggccttttctgcatctattgagataatcatgtggtttttgtctttggttctctttatatgctggattacatttactcatttgcgtgtattgaaccagtcttgcatcccagggatgaagcccacttgatcatggtggataagcttttggatgtgctgctggatttggtttgccagtattttagtgaggttttttacatcaatattcatcaaggatattggtctaaaattctcttttttggttgtgtctccacctggctttggtatcaggatgatgctggcctcatgaaatgagttagggagggttccctctttttctattgattggaatagtttcagaaggaatggtaccagttcctccgtgtacctctggtagaatttggctgtgaatccatctggtcctggactctttttggttggtaagctattgattattgccataatttcagctcctgttattggtctattcagagattcgacttcttcctggtttagtcttgggagagtgtatgtgtcgaggaatttatccatttcttctagattttctagtttatttgcgtagaggtgtttgtagtattctctgatggtagtttgtatttctgtgggatcggtgttgatatcccctttatcattttttattgcgtctatttgattcttctctgttttcttctttattagtcttgctagaggtctatcaattttgttgatcctttcaaaaaaccagctcctggattcattaatttttggaagggttttttgtgcctctatttccttcagttctgctctgattttagttatttcttgccttctgctagcttttgaaagtgtttgctcttgcttttctagttcttttaattgtgatgttagggtgtcaattttggatctttcctgctttctcttgtgggcatttagtgctttaaatttccctctatacactgctttgaatgggtcccggagattctggtatgttgtgtctttgttctcgttggtttcaaagaacatctttatttctgcctttatttcgttatgtacccagcagtcattcaggagcaggttgttcagtttccatgtagttgagtggttttgagtgagattcttaatcctgagttctagtttgactgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggggagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtgtctttctatgtcactcaggacttgcttttcgaatctgggtgctccagtattgggtgcatatatatttagcatagttagctcttcttgttgaatggatccctttaccattatgtaatggccttctttgtctcttttgatctttgttggtttaaagtctgttttatctgagactaggattgccacccctgcctttttttgttttccgtttgcttggtagatctacctccatccttttattttgagcctatgtgtgtctccgcacgtgagatgggtttcctgaatacagcacactgatggttcttgactccttatccaattttccagtctgtgtcttttagttggagcatttagtccatttacatttaaaattaatattgttatgtgtgaatttgatcctgtcattatgatgttagctggttattttgctcgttatttggtgcagtttcttcctagtctcgatggtctttacattttggcatgattttgcagtggcatgtaccggttgttcctttccatgttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcctccactctcttctggcttgtagagtttctgccgagagatccgctgttagtctgatgggcttccctttgtgggtaacccgacctttctctttggctgcccttaacattttttccttcatttcaactttggtgaatctgacaattatgtgtcttggagttgctcttctcgaggagtatctttgtggtgatctctgtatttcctgaatgtgaatgttggccttccttgctagattggggaagttctcctggataatatccttcagagtgttttccaacttggttccattctccctgtcactttcaggtacaccaatcagacgtagatttggtcttttcacatagtcccatatttcttgaaggctttgctcgtttctttttattcttttttctctaaacttcccttctcgcttcatttcattcatttcatcttccattactgatatcctttcttccagttgatcacatcggctcctgaggcttctgcattcttcacgtagttctcaagccttggttttcagctccatcagctcctttaaggccttctctgtattggttattctagttatacattcttctaaacttttttcaaagttttcaacttctttgcctttggtttgaatttcctcccgtagctcagagtaatttgatcatctgaagccttcttctctcagctcgtcaaagtcattctgcttccagctttgttccgttgctggtgaggaactgcgttcctttggaggaggagaggcgctctgctttttagagtttccagtttttctgctctattttttctccatctttgtggttttatctacttttggtctttgatgatggtgatgtacagatgggtttttggtgtggatgtcctttctgtttgttagttttcctctaacagagaggaccctcagctgcaggtctgttgaagtatccggccatgtgaggtgtcagtctgcccctgctggggggtgcctcccagttaggctgctcggggttctggggtcagggacccacttgaggaggcagtctgcccattctcagatctccagctgcatgctgcgaggaccactgctctcttcaaagctgtcagatagggacatttaattctgcagaggttactgctgtcttttcgtttgtctgtgccctgcccccagaggtcgataattatttattaatgtccttagcccacttttagataggattttttaaaattgttgagttccttgtatattctggatattagtgccttatttgatgaatagttttaaaatattttcttccattcaacaggctgtctcttccatctattgattgtttcttttgctgtgctgtgattgtttcttttcggtttctttgtatcatctataatttctttcatcaatgttttacagtgttttcttgtagagatctttcacgtccttcattaaatatagtcctcggtattttatgttttgtttctattgtaaagaggattgagttattgacttggttttcagtttgaccattattggtgtatagaaatggtactgattttttgtatttttgtatgttaattttgctgtatcttgtaactttactgaatttgctctcagctcttagagggttctttttggtgaagttctttggtttttctaaatataagtttatgtcatctgcaaagagggatgagaaaggtttaattgaaaaagcttatccccatcttggaaatttatggagccattaacggtgggctttttgcagctgtgacatgttagctacaactctcattggaaaatgggaaaggcttttctgacccataagggctgtctgatacatgaagataaaaacctaatgtttggccactttgttgttgtttcttgttctgttgttaattttagggaatttatttatttatttatttatttagtgtgtgttatagcagtgatttattttattattattattattattattaatattattattttttatttttttattgatcattcttgggtgtctctcccagagggggatttggcagggtcataggacaatagtggagggaaggtcagcagataaacaagtgaacaaaggtctctggttttcctaggcagtggaccctgtggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacgggatcccaaggcagaagaatttttcttagtacagaacaaaatgaaaagtctcccatgtctacttctttctacacagacacggcaaccatccgatttctcaatcttttccccacctttcccccctttccactccacaaaaccgccattgtcatcatggcccattctcaatgagctgttgggtacacctcccagacggggtggtggccaggcagaggggctcctcacttcccaggagggacggccgggcagaggtgcccctcacctcccagacggggcggctggccgggtggggggctgacccccccacctccctcccggacggggcagctggccgggcggggggctgacccccccacctccctcccggacggggtggctggccgggcagaggggctcctcacttcccagtagggacggccaggcagaggcgaccctcgcctcccggatggggcagctggccgggtgggggctgacccccccacctccctcccggatggggcggctggctgggtgggggggctgaccccccacctccctcccggacggggtggctggccgagcgtggggctgaccccccccacctccctcccggacagggcggctggctgggcggggggctgacccccccacctcactcccagattgggcggctgccgggcagggtgctgacccccccacctccctcccggacggggcggctggccgggtggggggctgacccccacctccctcccggacggggtggctgcagggtggagatgctcctcacttcccagaaggggtggctgccgggcggaggggctcctcacttcttagatggggcagttgccaggcagtgggtctcctcacttctcagacggggcagctgggcagagatgctcctcacctcccagatggggtcacggccgggcagaggcgctcctcacatcccagatggggcggcggggcagaggcgctccccacatctcagacgatgggcggccggacagagatgctcctcacttcctagatgggatggcggccaagcagagacgctcctcacttcccagactgggcagccaggcagaggggctcctcacatcccagacgatgggcagccaggcagagacactcctcacttcccggacggggtggcggccgggcagaggctggactctcagcactttgggaggccaaggcaggctgctgggaggtggaggttgtagcgagctgagaccacgccactgcactccagcctgagcaccattgagcactgagtgaaccagactccgtctgcaatccctgcacctcgggaggccgaggctggcggatcactcgtggttaggagatggcgaccagcccggccaacacagcgaatccccgtctccaccaaaaaaatacgaaaaccagtcaggcgtggtggtgggcgcctgcaattgcaggcacttggcaggctgaggcaggagaatcaggcaaggaggttgcagtgagctgagatggcagcagtacagtccagcttcagctcggcatcagagggagaccgtggaaagagagggagagggagactgtggggagagggagagggagagggagagggagagcaattttagggaatttattaagcttcataaatttatgggataaatggaggcccctaggttaggggtgatgccactgtgagattcagagtcacttcagtgtaaggaggctgcagcagtgtttagaaagtgtgtcataattatagccatattttgacttctggaggcaagggcaggaagtgtggcttttccctgacatacagttgccaggtaggcagttatttggttgcataaataattgtaattttatggaaaaattttggagattgaaaatagaaattaaaattactccaccattcaaaagcaattgttattaccatgtttgtataatttactttagagtttaaaattttcatgtatatatatttttaacttacaatgtagattaaataaatagagatgaggttttgccacattgcccaggctggtcttgaactcctgggctgaagctatcctcccacctcagcctcccaaattgctaggattaaagacatgatttattgtgcctggcctcatgtatattatggaaactgttaagattattttacatgagagctttatatttgcttaaggtttgaaaggcttcagagtttatgtaggaagttacagacaatgtttctgttcatgtatcaaaagaaaaataatattcagagactgaagtttttctagggcagtgccacaagggttcatgtccttagaagttagcagtggcctatctaggacagtgtaattgtggtgattgttttttgttttgttttccctattatctcttatccctggaaaacatctttcagcattaggcaatgtgctatttgacattgatcagtcccttaatttatggccacttttcctgcaggtttttatgcagccagtgttaaacagctgctggtcttaagctaaaggtgggaaggtcatggcacgcagtgtgggctggatttagaatatgaattgctacagttttattttgaagaacatagagcatcagtagatgatgggcatttagggcctccataaagactgcagctgaggaaaagattcacttataagtacaggagcatcatgttgggaggggtcaagttaattattgaccacagcttttacaatctgctttatcaaccagggctgcaggctgggaacttagtacagctaaattttatgtataaagaactagtgtgtaagtgggatttatgttatgtgtgcagaggtaggctggcactcactttttgcactatttttggctgaattaagggcctaaagatgggctaattcatggatatacatggcttccacataggcttttaaaagccactccccactctgtagtttcaagttggccatggatttgttaatcaaagtcaactgtgatcttagtactagaccattctgagacatacaatgcacccttgtccacagaagggtggtagaattttattaacaatcttgcaaaaagacatgagacttattattaaaaatggtccctttttgggttgaagtagaaaaacacctcagtgaagccattaccacaccaaagtctagaaagccggtgcctggaggactacatctcaagaatcagctttgctgaggaagccagagatgagtttgaagagtatgcttcaacccttctataagaacaagtgcaacagaatattgagaataacagaataagacatttaggaatatttaactgaaggaagcaaaggatttccttatgagaaaggttgaggttttattggttaaaatcaacagatgtgaaggggaagcaagaactgtaaggacagacaaatgtagatggtctacctgttctcagaaggttttagaaaatgcgttgtgctttcattgttgctatatcagaaagaaagaccggagcctgacaaaatttagagaggaagcaaggcaggatctcataaagtagagtgatccctgagagggtgtgcccaaatgctgcagactctctcataagtgttaggagaaaccaattctccaagcatatattgggacaacagtatgacttgatccagaatgttaggacaaatttgagggggaaaggtggggcagaacagagaaaaactcaaaacataggaggtgacttaactattatgtactgtattaaaagtattatatgctgttccttgaagaaacatccccaagcaatttttggttaggactcaaggtaaagcacagaaaagatgagttatattggagggatgtagacagaagaactataatatgtactgagcccattatagatgttgagtgatggaagggtatcttctgggatggataatcttcctaggagcctggatgtacacaaaatatgtttaaacagcagatatttttggcagacccagaacctgatgttttcatgtatctcaccatggaaaactctataaccacaatctaacagaatacactagtaaaatgtccgggcctgagagcaatgccaaagtaaaaagaaagaactcggatcttacaaacattgtgatcctacttggcagaagaaaagaaacctctgaggtaggttaatcagctaagtcttcttgaaactattagaggggaaaatgaaaacacttgaggcatatagcataaaagacatagcatacagaaatattcagagctggtagcatcctaaaccagaggaaatgtcatttcttggggagtaatcatgagggaaattttttccgtgagggtgctaggggtgcaattcaccagaaacagctttatttaaggaagttgctgaaggtgattctctagctggaacacttctagggactgagggacaggaggatcttcactgggaggcaggtttcacaggtccaaacaattctgtagtgagtgacagcagccactgtggctcaggaccaaaactaccagttcctgggatacagtgttagctacctggccagatggagtccactcttagtatagcattagaagggtactcagtggggagattgagactaaaaggctgagaaaatactgaatgggaagaacttctcagtagtacctgatgcccagtgagtggggtggggggtgatttcattgcaaattttagagattaaaaagccaggagtatctcagatgacaataattgggaaagaagataagcgaataagcctttaacccactctggtgccatagttatgataaatcccatatggtcaaatttaatctcttatgacaggtttctctcaatgtaagggttttttttttaatgtgatataatctatataacgtaaaattcactgtttaaaagtgtagaattcagtgatttccagcatattaactatgtagtgcaaccatcactattgtctcactctagagtatttctgccacccccccaaaaaaaaccctgtaccaattagcagtgagtcccaatttttcccttctctcatctcctaatgaccagaaatctgctttttgcatctacaaatttacatagtctggatagttcatgtcaattgaatcacgttatatgtagccttttgtgactggcttctttccattagcacagtgttttcaagattcatctatattgtatcacatagcaatattcatttctttttatagctgaatatgttttggatatataccacattttattcatttatgcatcagttgatgggcattacattgtttcagttttttagcaattatgcataatgctgctgtgaacttttctgtacaactctaatggatttttagggtaatgctcatataccccagacaagcatctcctgtagagatcttttacctccttgggcagatgtattcctaggtttttatttgttttattgtttgttttggctataagtgggattgcattcttgatttggttctcagcttgaatgttgatggtgtatggaaataatactgatttttatatgtagattttgtatcctgaaacttcaccacatcatttgtcaagcctaggagtcttttggagaaatcctttgggttttctatgtacagaattatatgttcagtgaagagagatagtttgacttctttttctatttggatgccttttatttctttctcttggctgattgctgtggttaggatttccagtactacattgaataggagtggtgtaagtggacattcttgtttattccagttctaagagggaatgtttctaaatttgtcttttcattatgatgtcagctgcaggtctgtcacagatggctcttaatattttgaggtatgatgcttagttcattgagggtttttattataaaggggtgagttgatcagctatttagtaaagttgaaactaatatttctttttcagatacttttgagtttctataatgacctttacaacagtatatactaggttctagaacataattatgtttgcgataacattactagcaaatgggattgctttattttctaaaacgtgtgggtgcggaaaacatgatgttcagttttgtatgttctagtaatgcatttgatccttaaaaatgaggcttctgagttgacttaggagtgaacaaacacaatttctgaggtcctgaagaaactgcagccactcctgagaaagagtcaggctgtagctgctgaaagaatgcagatatggagaaaattcatctaactgaaactgaagagaatgagaagttggagagaataagtttagaatttaagttgggatttgagacattaatttctttggattcatactgcacaacaaagacagcaggaatttttcagactttagcttttatggattttaaggttaagaatttgaattttttaaagcttttaatatttgaatttaattataattcctgggaaactattaatgagagggaaattatatttaattttggagtatcaatatgtggtgacatacgattattggactatcttacggtcattatttaatatcattgcagaagctttgaaaggatatattaggtaatatggctggatacaatttaagataggaaatagaacagaagtgaagttccagctttactgatctctcagcagaaactctacaagccagaagagagtgggggccaatattcttaaagaaaagaattttcaacccagaatttcatatccagccaaactaagcttcataagtgaaggagaaataaaatactttacagacaagcaaatggtgagagattttgtcaccaccaggcctgcccaaaagagctcctgaaggaagcaccaaacatggaatagaacaacctgtaccagccactgcaaaaacatgccaaattgtaaagaccatcaaaggctaggaagaaactgcatcaactaatgaccaaaataaacagctaacataatgacaggatcaaattcacacataacaatactaaccttaaacataaatgggctaaatgctccaattaaaagacacagactggcaaattggataaagagtcaagacccatcagtgtgctgtattcaggaaacccatctcacgtgcagagacacacataggctcaaaacaaagggatggaggaagatctaccaagcaaatggaaaacaaaaagaggcaggagttgcaatcctagtctcagataaaacagactttaaccaacaaagatcaaaagagacaaggccattacataatggtaaagggatcaattcaacaagaagagctaactatcctaaatatatatatgcacccaatacaggagcacccagattcaaaaagcaagtccttagtgacctacaaagagacttagactcccacacaataataatgggagactttaacaccctattgtcaacattagacagatcaacaagacagaaagttaacaaggatgtccaggaattgaattcagctctgcacctagcagacctaatagacatctacagaactctccaccccaaatcaacagaatatacattcttttcagcatcacactgcacctattccaaaattgaccacatagctggaagtaaagcactcctcagcaaatgtaaaagaacagaaattataacaaactgtctctcagatgacagtgcaatcaaactacaactcaggattaagaaactcactcaaaaccgctcaactacatggaaactcaacaacctactcctgaatgactactgggtacataacaaaatgaaggcagaaataaagatgttctttgaaaccaacgagaacaaagacacaacataccagaatctctgggacacatttaaagcagtgtgtagagggaaatttatagcactaaatgcccaaaagagaaagcaggaaagatctaaaattgacaccctaacatcatcattgaacgaactagagaagcaagagcaaacatattcaaaagctagcagaaggcaagaaataactaagatcagagcagaagtgaaggagttagaaacacaaaaatcccttcaaaaaatcaaggaatccaggagctggttttttgaaaagatcaaaaaaattgatagacctctagcaagactaataaagaagaaaagagagaagaatcaaatagatgcaataaaaaatgataaaggggatatcaccaccgatcccacagaaatacaaactaccatcagagaatactataaccacctgtacataaataaactagaaaatctagaagaaatggataaattcctcgatacatacaccctcccaagtctaaaccaggaagaagttgaatctctaaataggccaataacaggctatgaaattgaagcaatcattaatagcttagcaaccaaaaaaagtccaggaccagatggaatcacagccaaattccaccacagatacaagggggagctgataccattccttctgaaactattccaatcaatagaaaaagagggaatcctccctaacacattttatgaggccagcatcatcctcataccaaagcctggtagagacaaccaaaaaagagaattttagaccaatgtccctgatgaacatcaatgcaaaaatcttcaataaaattttggcaaactgaatccagcaacatatcaaaaagcttatccaccatgatcaagtgggcttcatccctgggatgcaaggctggttcagtatatgcaaatgaataaatgtaatccagcatataaacagaaccaaagacgaaaaccacgtgattatctcaatagatgcagaaaaggcctttgacaaaattcacagtgcctcatgctaaaaacctctcaataaattaggtattgatgggacataactcaaaataataagagctatttatgacaaacccatagccgatatcatactgaatgggcaaaaacttgaagcattccctttgaaaacggtcacaagacagggatgcccctctcaccactcctattcaacatagtgttggaagttctggccagggcaatcaggcagaagaaagaaataaagggtattcaattaggaaaagaggaagtcaagttttccctgtttgcagatgacatgattatatatctagaaaacgccatcatctcagcccaaaatctccttaatctgaaaagcaacttcagcaaagtctcaggatacaaaatcaatgtgcaaaaatgacaagcattcttatacaccaataacagacagacagagagccaaatcatgagtgaagtcccattcacatttgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtagtaaaacagagatatagatcaatggaacagaacagagctctcagaaataacaccgcatatctacaaatatctgatctttgacaaacctgagaaaaacaagcaatggggaaaggagtccctatttaataaagggtgctgggaaaactggctagccatatgtagaaagctgaaactggatcccttccttataccttatacaaaaattaattcaggatggattgaagacttacatgttagacctaaaaccataaaaaccctagaagaaaacctaggcattaccattcaggacacaggcatgggcaaggacttcatgtctaaaacaacaaaagcaatggcaatgaaagtcaaaattgacaaatgagatctaattaaactaagagcttttgcacagcaaaagaaactaccatcagagtgaacaggcaacctacagaatgggagaaaagttttgcaatctactcatctgacaaagggctaatatccagaatctacaatgaactccaataaatttacaagaaaaaaacaaagaaccccatcaaaaagtgggtaaaggacatgaacagacacttctcaaaagaagacatttatgcagccaacagacatatgaaaaaatgctcatcgttactggccgtcagagaaatgcaaatcaaaaccacaatgtgatatcatctcacaccagttagaatggcaatcattaaaaagtcaggaaataacaggtgctggagaggatgtggagaaataggaacacttttacactgttggtgggactataaactagttaaaccattgtggaagacaatgtggcgattcctcagggatctagaactagaaataccatttgacccagccaccacattacttggtataaacccaaaggaatataaatcatgctgctataaagacacatgcacccatatgtttattgcagcactattcacaatagcaaagacttggaaccaacccaaatgtccaacaatgatagactggattaagaaaatgtggcacacatacaccgtggaatactatgcagccataaaaaaggatgtgttaatgtcctttgtagggacatggatgaagctggaaaccatcattctcagcaaactctcacaaggacaaaaagccaaacactgcatgttcttactcttaggtggtaaatgaacaatgagaacacatggacacaggaaggggaacatcacacactggtgcctgttttggggtgggggaatgggggagggatagcattagcagatatacctaatttaaatgaggagttaatgggtacagcacaccaatgtggcacatgtatacatatgtagcaaacctgcacgttgtgctcatgtaccctagaacttaaagtataataaaaagaaaaaaaagtatgtgtatgtatctatacatatttataaaagaaggcaacatagtgacagcctgttagagacccaatttgcataataaaagatcagggtggggtggccagcctcttcacgtactatataaagggcacacctggtttaaccaatcctctgtgccctatataaggcagacatgacttcctcaagctcatctataaaccaactgcatcttgctatgaacctggaaaccatttgggatctcttcctctgcaccagaaagctctcttctttgtttcacttattaaacttctgctcttaaacccactccttttgtctgtgtctgtgtccttgatttcctcggtgtgaggcaatgaaccttgtgtattaccccagacaaatgaggcagcttcattgtgggggcttgtccaggattatcaaaagggtgagtataggagtggacctcaactctgtccttttatttcagggctctcagcctccattttaattatttaattattttatttttttgagacagagtctcactgtatcactcaggctggagtgcagtggcattatcttggttcactgcaaccaccacctcccaggtttaggtgattctcatttctcagcctcctaagtagctggaattatgacacatgccaccacacctggctaatttttgtatttttagtagagatggggttttgccatattgggcaggctggcaccaaagttctgggatgaggtgtgagccaccacacctggcccttaacctccattttaaagtcaaatcaaaccatatactgtgtgtctgatggccacctagatacctctagtgtgagccatgcttctcaaggctcagatgacaggcttgttgggctgtcatgatagtgaatccactagtgccctcaggttgctgggcttattggttatgtttcaaaccaattttccttcatggaggaactagccatctcatggggcttgaagaagtcctagggcaactgacaatttctggccagggctaaaccttgatgtaattcaaaagctttgggactgaactcagcctccagctgctcaattggatcagcaacagaatctccagcttttctattgcagaatgttctcctttcctatccaccaccatcatgtctcctctctctgtatgcaatatcatgggaatttttacagttcagagaaatagtcctgttaggaaagatcaaaaaatgctatagtaactacaaatatagctcaagggaatgccacttttgtaactttctagaagcagaggtctcccccagcgagtgtttctacccttcctctggcaagcatatggtatttctaggtcagcagcgtcaactagtggagtatccttaccatgagtctcagtgttggtcctttgctgagacactccagcttcccaattctccctttttgtgcccctctaccagattccagggtttatggctttctgtaaatgggaaaaactatgccatgaaagatcaggaggaaaatgtcctctgaaactgttttagtctgaacactgtcccatcagcaggaaaaccaccatttgatccctatgttcttttaacacaccaatcctgcttgcagttaagacaatacttaaatagtaagggaattttaagtccagaagttaaccactaccattctctaggggtaaatcctttagcacgacccacaatagcaggatatagagttcaatcttgtacaccccctccattaaaggggccatgcccaaattcaactattacatagtctttcctgagatccatttttcagggagccatgaagatcatacaagtctaggaagtcagggtaatcaaaaacagagaactagggctgcatgggtacacatgactaaactcatcacttaattcctctggttccatggctggggaatcatgcctgcaaccatgggtagcatgtttaacaaggtgccaggagcccaggaaccaaagagagaaaacagtagggggaatgcccccactgtcttcccctccaccctgggccatcccaaggaaaggatccttttattctcagttctctttctagatgggtaacagaccatctttggcctgtactcctctcaagtgtattctaaagcactgggactcatttaaccccaaaactttgaagaaaaaagcagctcatttttctttgcacaaggggatggcattctttctagacctttgcaagcattgcaaaatcaacccagcttttttagcagtcatatcaggcaggtctgtagagaatgatttcccacagtaagagaagcaacttttgagggaaccatctgagaattccccttatctgaggcccctttaagttcccttctcattacagaaccttaggcagattaagggggtcttaggccatgctgctcctaagccaaaccctcactgctactcaaaaacaggcagctctgtaggcagtagaacattttggagatgaacaatatatctcctataataggccaaaaaggaaaaaaggagatagggaaggtgatatggtttggttctgtgttcccacccaaatctcatcttgaattatactcccataattttcatgtgttgtgggagggacccagtgggagataatttgaatcatgggggtggttttccctatactgttctcataatagtgaaggagtcttatgagatctgattgtgctatcaggggtttctgctttagcatcttcctcattttttctagccactaccatgtaagaagtatctttcacctcctgtcataattctgaggcctccccagccatgtgaaactgtaagtccaattaaacctctttttcttcccagtcttaggtatgtctttatcagcaggatgaaaacatggtacatcctacatcagcaagatgtaaattggtaccagtagagttggcgttgctgaaaagatacccaaaaatgtggaagtgactttggaattgggtaacagtttgcagggctcagaagaagacaggaaaatgtgggaaagtctggaaattttgcaaagacttgctaaatggctgtgaccaaaagcctgatagcaatatggacaataaggtccaggctgaggttgtctgagatggaggtgagaaacttgggaactggagcaaaggtgactctcattatgttttagcaaagagactggtggcatttggcccctgccttagagatttgtggagctttgaacttgagagagatgatctagggtatctggcagaagaaatttctaagcagcaaagcattcaagaggtgacttgggtgctgataaaggcattcagttttataaggaaaacagagcataaaagtttggaaaatttgcagcctgacaatgtgatagaaaagaaaaacccactttctcaggagaaattcaagccagctgcagaaatttgcataagtaatgaggagccaaatgttaatccccaagccaatggggaaaatgtctccaggtcatgtcagaggtcttcctggcagccgctcccatcacaggcccagaggcctaggagaaaatggttttgtggcctggggcccaggcctagggacttggtgccctgcatcccagccactccagctgtggctgaaaggggccaacatagagcttcagccatggattcagagggtgcaagccccaagccttggcagcttccacgtggtgttgagcctgtgagtgcacagaagtcaagaattggctgggcatggtggctcatgcctgtaatcccagcactttgggaggccgaggcaggcagatcatgaggtcaggagatcgagaccatcctggctaacacagtgaaaccccatctttactaaaaatacaaaaaaattagctgggcatggtggcggatgcctgtagtcccagctactcgggaggctgaggcaggagaatggcgtgaacctgggaggcagaggttgcagtgagcagagatcgtgccactgcactccagcctgggcgaccttcacctagatttcagaagatgtatggaaacacctggatgctcaggcagaagtttgctgcaggggcagggtgatcatggagaacctctgctagggcagtacagaagggaaatgtggggtcccatacagagtccctactggggcaccacctattggagctgtgagaagagggccaccatcctccagaccccagaatggtagatccactgacagcttgcactgtttgcctggaaaagccgcagacactcaatgccagcccattaaagcatctgggaggtaggctgtactctgcaatgccccaaggatagagctgcccatgaccatgggaacccacctcttgcatcagcatgacctggaagtgagacctggtgacaaaggagattattttggagctttaaaatttgactgcccctctagatttcagacttgcctgggccttgtaacccctttgttttggccaatttctcccatttggaatggctatatttactcaatacctgtaccccattgtatctaggaagtaactcacttacttttgattttacaggctcataggcagaagggacttgccttgtctcagatgacattttggactgtggactttcgggttaatgcagaaatgagttaagactttgggggactgttgttggaaaggcatgactggttttgaaatgtgaggacatgagatttggaggggccaggggcagaatgatatggtttggctctgtggctccacccaaatctcatcttgaattgtactccaataatttctgcgtgttgtgagagggactcagtgggagatcatttgaatcatgggtgcggtttcccccatgctgttctagtggtagtgaataagtctcatgagatctgatggttttattaggggtttctctttttgcatcttcctcattttctcttgtcgctgccatgtaagaagtgcctttcaccttccatcatgattcttaggcctccccagccatgtggaactataagtccattcaaacgtattttttcccccttgtctcaggtatgtcttaatcagcagtgtgaaaacacactaatacaaaacacaaagaaataatggaaacacctttcccaataggaagggaaacagtccctcctgacaatccctattgaaactctggtagctctgcaaaagaatggaaaaggcaacacttttttttttttttgagacggagtctccctctgttacccaggctggagtgcagtggtgcaatctcggctcactgcaagctccacctcccaggttcataccgttctcctgcctcagcctcccaagtagctgggattacaggcacccgccacgacgcccagctaattttttgtattaaaggcaacattttttaatgtacttatgagagggcttacaaagaactagggctaaacctgttaattactctaagctgtccttgatagaccaatagccagataagaattacacagcctttatggaaaggctgagagagctactaacaaaccacccctccttatcccttgattcagttgagggacagctcatcctaaaggacaagtttatcacacaggctgctcctgatattagaaggaaactgtgaaaggaggctataggaggatacaccaccttggaaaacctcctgagggtggccacttcagtcttttataatagatatcaggaggaggcccagcagcagaaagagaggaagcacaagaaaatgacagaggctgtagtatctacctgctttgcaggcttgcaaaattcaggatccccaaggtacatctgctagtggctatcaatgtggcaagtcagggcactttaagaaggagtgctcaggcagcaaggaaatgccacctcagtcttatccagcttgtggcaaagaccactagagatcagactgcccccagtgatggaggtcactgtgttcagaaccagtctcacagatggtccaacaggactgatgggttctggggctcaaacccgtggctccagtggctcaaactgccattacagcacagaaaccccaggtgattctggaaattgaagaaaggaaggaagacctcctcctggacactggagccagcctctctctctctctctctctctctctctctctctaatccaggccttcccacttcttgtagcaccaccataagggacatctcaggaaaaactctaatatttttctcgaccccttagttgcagctagagggacctattatttacaaatacctccaagccattgtcacagtgaccctactggtcctagatgccacaaattaacctcggaaatgacttaaatgtttacacctcacataatgtggaaggattactgtcctctagggggagcctttggctaatagtcggctccttaaatattaggctctgctcttagagggttccacaatccagttaaaaacttgttctcacctaaacctagccactttcctccccaaggaaagtggggaaaatgaacatgactgtgaacaagttataatacagacctatgcagccagggaagatctcagggaaaatcccctagaaaatccagactggatcctcttcaaagatgggagctcctttgtagagaaagtaatcagtacggcaggattatgcagtagtcactctaaatggcatcattgaaaatgtgtctctctctccaggcacaagtgctcaattagctgcactgacagatcttaaaagaccacttgaattaagcaattgaaagataggtaacatttacactaatttgaagtatgctttcttagttctccatgctcatgctgtcatttgtaaggaaagacactgtcttacagataatttatggcctataaaataccaccccaaaattaactggttattatcctcagttttccttccatgagaaatagcagtaatgcattataaagggacatcaaaagagagcagatgaagtagatgaagaaaataggtttactgatcaggtagctaagtcagtggcaaggaagccttagcacatcaatatacttcaagcccctctaatctggaaaggctccataagaaaaattaaacctcagtactcccctgcagaaatagaatgcatcacttctcaaaggtatactttccagccttcagggcggctacactcagaggatggcaaactcaacctgccagcctccagccaatggaaagtccttaaatccaccaagcatttcacttaggaaaggataaaatttatcagtgtgtccagaaattattttcaagagagaatttattaagaacagtgaaactggttgttaacacttgtgaaggtgggttttttcttctcaaacccaaaggatgggaagctttccaggggaggactggcagacttcacccacatgccagagatgaagtgtagtcaatacctcctggcatgtgtagaaactttcactaactgcatagaaatctttccatgccatacagaaaaggcctctgaggcaataaaattgttaacgaaataagtcctcactttggtctacttaagtacctccaaagaggcaatggccccccatttaaggcaggtgtcatgggcggggatgtggggtggatctcaaacacactaggcatacagtgtcatctctgttgtgcttggagaccccagtcctaaggaaaggtagagaagacaaatgatactatcaaaagacacctcagaaaactgtcccaagaaactcattttccttgcactactcttcttcccatggtcttactgtgggcaagaaataccccttcaaagttaggtctgagcccttttaagatgctgtatggatgcccttttcttaccaattattttctgttagatcaggaaatatctgagttagttaagcatgtaacctctatggctcactttcaacaggaattaacacagttagccaaagcccaaccccaagaaataggaccacctttatttaaccctggagatttggtattggtgaaggctctcccttctctttctttctccctgagcccaagctgggaagggctctacactgttcttctttcaaccccctcagcggtaaaagttacaggtatcaactcctggatacatcacactggagtcgaagcctggaaagctgtgggagcaacccctgacagccctgaggaacatcctgaatatcaatgtgaataaataggagatctgaagctacaaaccataaaaggtaagtgagggctacccatcttactcagtcccacctttatctcatgaaatactttcagtcatttctacttttctgtttagatttgccaccagatattagaacttctttttaatgcatatttgcagaaagattttaattatccttgggattacatgtacaacttcatagacccccagacagaaattctatgtcttggcaagtaaaaattttcaatggaaattatctactacaccacctttgcaggactgtatactcactctatttgcagtaggactatatactgtagaatgcccagagtggaatgctggataaagagtctcaactactgtaatattttgctgaattattatccttatagcaggcataatagttacctgacaggaagtaaacataaaagttttactatcactaagtctgctaggatgttttattgggtttgtcaatatgtcacactctagttattcaaagaaggttataaagaaaggtgattttatataagaaaggatcttctatggtaaattattgtcctaaaaggaaataactggtagttcaaagagggatgtttagcacaaatcagaaagtttaagcatgtcataggtagtctgtggaggttgtgaaagtattaatagttgctggaaaatttagccaaagttaacactaaagttactctagccacccaaatccaatgccacttatcctaaaaagaatgttcctttttttttttttttttttttttgagacagagttttgctctgttgcccagcctggagttcaatggcatgatcttggctcactgcaacctccacctcccaggttcaagagattctcctgcctcagcctcccaattagctgggattacaggcacctgccatcatgcccagctaatttttgtattattgtagagacagggtttcaccatgttggccaggctgatcttgaacttctaacctcaggtgattggcctgcctaagcctcccaaagtgctgagattgcaggtgtgagccactgcacctggccaaagaatgttacttttatattaacgtttctgctaaggtacagccacatttggtggaggcaaactagtattacaatccattagaatagctaacagatatcaaactctactgccatgcttatcacctatagtacctccactaataatggtaatctcaatacttatattcaaaccctatattctaaatcttcttgtaaaatttatctcttttcatctagaagtaatcaaactccaaatggtgctgcagacagaaccatccatggacacgcctttcttctgaggacccttagattgaccccaggaggagccctaactgctgttccctacacaacactccttttcagcagtaagtaccagaaagactcatcatccaacaccccctaacagcagttagggataccactcctgagggggaaatgatacagcagctaaacataaattatttaggcagattgtgaggacaaaagagtcctcagtaaggtttccttttaacaaatagcagccccaaaattatttctaacaaaaagcagcctgaaaaatcaagctgcaagcatacataagcaagctggaagcttgcgctggcagctctgccaatagaaaagggatagctggaagccggctatagtcagcatggaggttccttttcccctttttcaccacatgtgcagtaaaaagcagacaacatggtaccagtccagtagagaccccatttgcataataaaagattacagtggggtggccagtctctttatctgctatgtaaatagcacacttgatccaatgaatcctctgtgccctacataaatcagacaacacttcctcaagctcatatataaaaccaacccagaaacctgtttgggacccccttctctgaatgaagaagctctcttctttctttcaactattgaacttctgctctttaacccactccttgcatgtctgcatccttgattttcttggcatgaggcaacgaacctcagttattaccctaaacaatgctgtgtcaactcctctcgtaatgctagtttgcacagctcatggctccaaaagagaccccttccttttgaggaaaggaagagagaagagcacggagaagtttgtcttacatcttggatatcagcttagccacagcaggacaggaactggtcagtcataagaccccaattccaggccctagcttccagatgacatttctagacacaccctgagccagaaggtaacccaatgccttgaaagaaagaatcaagttttggcagcattcatcacctggtaactgaggagctcttgggccatgaataatcagcagtaatacccaggtactctgttgaggacatttggtgattctctgagacttactggcttcaggtgagatccagcacattgccaactgtgttgactacgaggcaaaactcctgcttgagaaaagcagtagaaaaaataaaagagattttggctcgcaccttaggtactagcatggccacagggttgtagagcaccaagaaggctcatggggaccctattccatgacttcacttttgaattacatttctggatctgccctgggccagaggggagcccactgtcctgaagggtgagtcccagaccaggcaacatttaccacaagctgactgaagagcccatgggccttgagggaacactggtggtagtctgtcagtactccgcgtggcctggtgtggtggtggcaatgaggtgaaacttttcttcctttggaaaggggaagggagagtgagaagaactgcatcttgtgctttgagtgccacctcagctgcagtataatagaacaccaggcagacctctaaggttttttactttagtctctgacacccacatggcaactctggacccacatggggcctgggggagctggctgtcctgaagggaagaacactggcctggctggcttgccataagctgattatagagccctagggccttgagtgagcataagtagtagccagaaagtggtcacagcagaccttaggtgagacccagtgctctgtgggcttcagttctgacccaggacagtcacactaacagcagggagagtcatagtgttggtggccataggggtgcttgtgtcactccaccttcagcattaggtggctcagaacagagagagattgtttgattagcagaaagtaagaaaagctaacaaaagcctctgcctggtaatctaaagaattcccacagattttgtttaagaccatcaaggtggtacctctctgagtctacaagaaccatagtgttactgtgcttggggtgtcccctaaagcagatacagcttagatcacaacacccaagttctttctaatatctggaaggccttccaaagtaaaatggctacaaataagcccagacagtgaagactacaatagatacctaactcttcaatgcccagacacaaactaatatctacttgcatcagtatcatttaggaaaacattacctcatcaaacgaactaaatagggcaccagggaccaatttgccttagtatctgttttcttttggttactctttagtgccttcaggaaggtttattttggttggtttgtccagagtttatagttgttacctgtgtgtatgtgttgagaacaggggacagagaggtcagtcacttttagaagtggaaccttaaagagctttttttgtgtcatatcatgtgcaaacctgttagaattcatgttaaaattagacatgaatgataccaaaaacatttcagcactatggtataaaaccataccttactgttgacctttcttttgcctattttgttcatacttactatttatttacttaaatccctcctcagttttaattcttgttttctaatgagttactgagtacttaccagatggaaagcactatgatagattctccatctgttgaaatattgctcattcaaaatccaaatcaaatgcaaacaccctccaaggatcactcccttgcctcctcctaagcagacgtgatttacttttatctgaatgcctttggtactttgtttttaccttatgacattagatttattaatacacttgctttctccccaccacaatcagttctttgtccctattagatcatacacttcatcagtaagggcaagtctcactcatatttccatccatccatgctgccttaaacatgctttctaaagtcaggaactaaaaaataaaaagaaagaatatctttgcagctgctcagaaagaaaagaaaataggacattagtttcctgtctgtgttctcaatagtaggatcggacatcagttaacaatgcattctttatttttagcgaacatctagacagagaaaactgtcttttcccttctcctcgttatttttcctctttcttcttcctcctcttccttcttcctttttcttcctccttttttcatcttgtcctcttcctcctacttacccttccccctttatcttcctttgtccctcctctcttctcactttctttttctcactaattatagtctcatttaaactttttttgtatgcttagtctcatctttaaaatggggaaacatatatgtgtcattatgaaatgttttttgctttaaattgttaaagatcagtaagggagtcttttttcttcacctttgaaattgtagtgccaaaactcagacaaaccagtgatgttccaaaagttgatgggagaagaacccaaacatttgattcttccttcattgatttttctttcattggtaagatattttagtgaaatattatatgttgaattgtcaataacaaaagccatctacaagcattctttttcctcttttagccatagcaacaaacatgccataaaatggaagttatagaaataaggttaagtgaattaaactaggttttgtaataagctcacttcttccttagactcaggtcagaagacatttaaaagaagaggatctatcataaactggggctgttgctggggttctagcacttgcctggacaatgtgtctgcaccatcaacatcacctatgcctggacagctctttggagtttctctgccaaatatgtgtgagaatgacaatctgctcaaacctgtcctggtaaggctcacttgacctgttagctaatgggaaagggggtttgggaaaggagagctctgagaggtaaatatgtcaccaaatggaaaaattatagacgccactgtctttggctaaaaatctgatttaactactgtagaatcataaggaagacatatagggagagatcatatagtttcctgatttcaggaaagacccacataaacctactcagataaattagaattttctctttagacagagaattcacattctctcacacaaatcctttcttcaactccacattgttatgaaagtcctcttttatcagtgtagcagcagagactactcaatgttatgcttaagttttaaaaacttttattatttatatgtcaagtacttaagcataaaggtacgttccctggcattcatttatcttttgtctgtagaatgggtcagatgaaaaccactgagttatttccagttgacatattaaagaatcactactaagcagcatttattgagtattcattatccttcaggtgttatactagatgtgtggcatttaatgctatattgttcatctataagtgccagacactcatctagccaccttattatttatccttcacagcaaacgtaggaggtggttcttactatgtcaccatctctacttcatggtctgtgttttcaaaagcctcagtactttactcaaggatacatagtagctaagtggcctaactaggttttaaatcctacagattgcttgtctccaaaacccattctcttcctgcactgtaagcagaggacatactgatacaaagaaagcaaaattagagaacacttaaaatccactctcttagccatttttagaaatgcagtaccttgttattgagtatagtaatcatgttatttaatagagcacctgaccttacttctgctatctaactgaacttttgtatcctttgaccaatatctccccaacctcaccaccaccccagcccctggtaaccaccattgcgctccccaaaaaaattgacttgaatctttctagctgttcttttagtcccaatcttttagtacttttaccctagcacaaccccatagcctctggtagccaaagggggtaagtatgtgccaaaaaggataagtattcccttgtctgtatgtgtgaaatgccattttgcttatttcctttgtttccctattggatgtacttttctttcttaatcaaaaaggacccctcaccaaaggtgtcttcaggaaagcagccagtttaaaatcctgcagaaaatgagaaattaaattctggaggtgaagtaaacctagattgtgaatctatttttgagatagcctctgtattgaaggtaagaaaaattttcttttaatctacctgatggtatagctctggagcaagaaaaaggtgtttttattttttttatgaacattatttatatttgcaaagacccataatcaatttataactttaacactaaaagagtgttacaaacacttttataaagtcaacattggactttaaaaactaccaccagtgatatgacatatcaaatatgtttaaaaattttttttcccacactaacctcatctttacttctgcaaccccatgtaaaaaataaaactttgttaaaataataaaaagacacacacatttaccaaaacaaacatcatgcctattagtattttctgtcttggccaggcatggtggctcacacctgtaatcccagcgctttagggggctgaggaggggcagatcagttgaggtcaggagtttgagaacagcctggccaataatggtgaaaccccatctctgctaaatatacaaaaatttgcatggtatggtggctcacgccagtaatcccagctacttgggagtctgaggcctgggaatcgcttgattcttggagaggaaggtaacaatgagccgaggtcacaccactgtactccagcctgggtgacagagcaagactctgtctcaaaaaaaaaaaaaaaaaaaaaaaattctgtctcactaccttcataataaaggcagttttcaaaactaaacttttgttgcatgtttgaaaatagttacagaggtttgccataataaacatttgcctcacaactgaaacaaaaaaaattgctgagatcactgaaatttttgtttacataaccattacgcccaaaaatactcttttccttgttccctaatgccttttactctaaaagtggagtgggaacaatctcagcatctgagttccttttacctttaccacatttgatattctttgtggttcttaccctttagccatggctacaaaagtcacatatatagttacagagatagagttctaattttttttctgccccacattcttgcaaatgccctacctttttggaaaacctcaagtcaaaactagcttaaagcagagattttgaccctacagtatcttctgcagacctgcctcaggctcccaccttccaaagggctgaaatgcaccagagcccggagtagagacaaggccccagcccatatctcagggcctgcagcataaaaacaaaattaaggaaaatatggtgaagaagactcttgcatacccctacttcagcggagtggctagatgccgataaaatcttatgtcatgacttcatgtacaatcagacattttttgataaacgagccatgtcttttcttaaacccagccgtagacttttgcaattaaatattaggccagagaactgaagggcttgagctaaggtcatttaacctgtttgcagagggtttgtgattactcttcaatcctgcaaaacaataaagacctttttttttttttttttttgagacggagtctgtctctgtcgcccaggctggagtgccttggcgcgatctctgctcactgcaagctccgcctcccgcgttcacgccattctcctgcctcagcctccgcagcatctgggactacaggctcccgccaccacgcccggctattttttttttttttttgtatttttagtagagaccgggtttcaccgtgttagccagggtggtctcgatctcctgacctcgtgatccacccacctcggcctcccaaagtgctgggattacaggcgtgagccaccacgcccggccaataaagacatgtttgatttatttagccccagatatatatgccaaggatttttatgcataatgaatttttcttttttctttccatataattaggttttcttctacttcttagtttacaaaggtaaagcctgtgtttcatggaataattttttgaaaaccaaaaatgtctgcaaaaatttatcttactatgctatttttcatagcaccatacttcttaaaattttgtgctattgatgctgttgtaaagaagcatgattcttgaaggttaaatgtgttacaaattggagaaatatttgtccaaaaataatgaaaagacaaaaaatgatccacatgattgaagagtctgtttaaatgggttccaagtaaatgacattttatcatataagtaggttttactcacttttcttccaagtggttgcaggaagggacataatttttgccaaagtttttgagtttttgttttgtttcttgttttaaagtctattttgaagtggcacttaagttttcttgtaatttttcacttatgcactggttatgcttagatataagtttagtttaagcctcaccttgacttttcaaactataattggacaaaaatgcttgagatactatagcttggatccatcagattttgagaaaaagttcatatttactcctgcactatctcaactcatgagtttgggaattctgccgatgatctgggctctggttttggaggagaggagacttttagttacatgctgtgagttggtgattgcaattcagaaccagctttcacatccttctcagctgtgatggtggctgaatttcaaaacttgttatttcacctgtgggagagttcattgagatgttatgagttattttctttcaagtgtaggtttaagatttagtggtgtttttctttaagacagatcataagtatatttttcactgagatttaaaaggaaagctattgtcactatcccgttttgaaataacagattttgctgcttctaaactggacttctaatgtgcatacagcagctaaaattagtttggaattatgaaaatttaatagctgtatccccaaagaggtaacttttgtaattatatccctgaatcacaaatattcaggtacatttctactactggaagatataatagaacaaaggaagagtttgaatcaatcagtcttctttctttctaaaaaaggtatagcaataaattgataccactacaaagaggttcttcaaattgttttagaatctcagttccagttgattggttttttctcggctctcattaatatttggccatatgacatatgacagcacttcactaatgacctccactgtggctgggactgtgcttgacattgacatgtaaaaagaaggttaagagtctgctcctaccctggaggagctcataagcaagtgggaaagatgcctacacaatcagccaactgtaacaataagttatcacagcttccatattagtgttagaaacatgatatctaagtaaaacatggtgtgttgcctttcataagacatatagagaaagttattgatttggttttccagcaagagttaaaattgcccaattgaagacttttacctgtccccatgttgtaatcaggaaattgcaagaaggtaaacaaccatgggtacagtgcttaaatatgatattgagttcactctgcctaaagtttactgaggtggagaacagactgcaagcttgatcttggtaatgtcatgccaacagcaacagagagagttggcctaaaatcaactctctaggatcaggacaagaattgaatttagttatttttaagctttttgtaaacaaaagccaaacaacaaatgccattggtcatatccttttgtgtcatagtgtggtttcatcacactcagccctgccagtggtctcagcataatagaatctctaagaaaagaatatactgtggacatgttatttagtgtacatcaagtgtgagaatgctgcccccatgcttccaaatacagccatcacgtggaatgctttctctctccaaatgtaagagaacttttctatggggaatatagggaaaaagcttacatacctcatgatgcaatcatggaatactgctggatataaagttctaagataatagggactgtgttttatctactactctatccctagtgactcaaatagtggttggcacacaagaataaatgcacatagaatgattgactgaatgaccaccaaattattaacctcatagataccttagtgcatttccatgaactagccatctaaggaaagagaaaaaaaatgatttagtatagtttactgccagaccctgtcagatttgactagtttgctaaaatgtatgcaaacaggaggtttcagccaaattggttgttctttgcctttcccatcataatgcagacttcaattatttctataattttttttagaaaaaaacaaaaaatacttctgtttccacaagtcagtggagagttggcacagaggtctgtgtagttccctgaagagagtacttaagtgaacttttcaagaaaatactttctgatttatctaacacatacttggcatgagaataataatttaaaatacctgtttttccatcaatgtaaagattttctgcaaagtattccaggaagtgttttttgtcagatctctgtgatcactgggtctgggtaatggatgagggaaatgatgaaaagaaaataaattctgttcaaatgtaattagtctaatttggtcgtgtctcaaaaatactattaaaaagattttataagcttgtttattaaaataatgacaaatatcaaagtcatatccatggggaccagattacaatatatttatgctggcttatcattgttattgtttttctcctttagcttattaacatgaaatatttaagcattgtataccttctgtatatccgaatctgataggagttgatattcattagtctgctagctaatactgtaggcccaatctacagtttatgattgtaattttggtaaatatttaaccagacaactcatcatatatttcattcaccaggtgaagtcatagagattatgacttattctctcttctcagggaactcacactctggtaaagtagatagatgaccaagaattacaattacgatgcagtataatcagtgctgtaagagatatttggagagtgctgtggaagcatggtagagaggcagttagctacttaaaaagtgtcaaggaaaagggggattgctactctctctactcatgcaaaaaaacaaaaatgctggtagaactcaggaccccatgcctaaatatttcctgcattataaaagaataggaaagaaatatccattaacaaaaagcaatacttctagttctatgaaaactcaatatttttcacttgcatgttcttatttagtactgtgtgttttttttcttgagcaattttcaaatatgaattatctacatctttcaccaataggagaacatagtacagctgctgaggacaccagaaaccaagggcatttatcaaaacactatcttcacttacattatagtttggcgtaagtcattcagatagtgagcatcaaattctatactttatttctaattgtctaaaaccttatatatcctataagctgttaaaggattttttaaagtaaaattatgactctcatacaaatgtaaaataaacacatgaaagattttatttaagtcatttatgagggaaccagtaagatgttacaaccagttcaaaggagacttcaaagttgaaatattatatatatagttgaatcagaagtgctaaaatgtggggccaggcacggtggctcacgcctgtaatcccagcactttgggaggctgaggtgggcggatcacctgaggtcaggagttcaagactagcctggcctacatggtgaaaccctatctctacaaaaaatacaaaaattagctgggcatggcggtgcctgcctgtaatctcagctacttgggaagctgaggttagagaattgcttggacccgggaggctgcagtgagtcaacatcatgccactgcactccagcctgggtgatagagtgaaattccatctcaaaaaaaaaaaaaacaaaaaaaaacaaactccccaaacaaacaaacaaacaaacaaaaaatgctaaagtaaatttacaaattgatacaaacaaaactggccttttctaccagggcaggggtacatgcggctaaatcacttgtctctccaccagacatacttttcacatcattagaccagtgttagatgggctgctgtcagttatttataacttgtaaagttacaaaataactcttcttgtgaagaagcttggggccccgtagaagcagataacccagacgcttatgctagatgtcttattttccattgaatacacccagtaatttttttgttctatttaaaagtctttcataatttatccttacaaaaactatattcattgttagtccattgtattgcaaaagacctgcctgctatttgtggagcattattcagactaccttgtttgccctagcttgcaggtttttattgaaaaaaagaacagtcatcaatatcagcatgcacacacacacacatacacacacaagcatatatatatatatatatacacacacacacaagcacatatacatatatatgtttaaatagtagtaatcatttttggtgagtgaccatttcaaaatctcttatcaactacaaaatgagaactgtagaaaatataatactataagcaactcatatgtgaaaatggtacaatgagacagatttaggacaaaattgaccttaaggttttgattctttccaagacagcatttctgggttactgcttggaaataaaggtatactttaaatttcattgctgtctaatttgatcagaaagctttttgtgggttttagttgttaatattctgaaatgttaaagggttgacctaagtttaaatgcattgtactagtttcagggaaatatttcaggcatcatttttatgaggcattttctgcattattttacatttttgagttgtgaagacagtgtacaaaaacaaaaaaattcccagtgcttattttttctttctgtccagacagtcctcacttgtgtggtatcatgttaactgaaacttctgcatatatgaaccatgttgttgatttgcactcttccccatgcaaagtgaaaattgcatgcctttgcaagtttttaaatacaatgtcttgcttaaagagtgcatttttctttctttacgctatgagaccagcttctgagtgccaatgttgttagcctaaggtatctctttggtatattacacaatattgagcaacaatcctcaatcaatcacatgaatgcatataatttagtggtatgtgtcacttcaagcattatttggtctcctacctcctccatccaagaactaaaagatgaatttaaaagaaaggtaataaagtttttcacttttatgccttgggggactgagcccccattttgaaactgaaatccagagtatcaattctgaaagatgatttcttacataacttaagtacacatacttcttataaatttgattttactgataaactataggaaagtgatttgttaagtagaaaagtgatcacaatcaggttgcttctttcttccctttaaggagtctaaacactaagagtaaattaatcataaagtgataaaacagttgatatgagttttcagattcaaaaaacaagagaactttggagttaggccagcccagattcaattctcagtcccacttcttgccaggcgtacaatcttgggcatcattcgttacattgacctaaagtgttatctgaaaaaaaaatggggttggtgataatagagtagttacttgaaatcacagttttgcagtgcctgacagttaataaggggcttggagatatcagttgcctttgctctcaacgtttctcctgccccttggccccagtcctggagcacagaaactacagaaaggttccagtgcatctcagtggaggcacacaatgtccctagtaatctctgacctctcccccaggtgccactagttagggagtctagtgaaatgctacacaggggtagaccagtcagtccaatgcatgcatgggtagagactagacagggaaaatacaagtttttttcctagctgtctttctttttcacgatgcacccacagatgagccctcctcccaagtttatgacaacctgccctttatataaggaatacttttcataagcctttgtctaatgatgctttataaacattaataacacagtgtatttgtttaccccaaacatcctatggagaacacttatatccaaattttaaagacagagtcactggtataaaattgtagcattaagccaaggccagaagtaaaaactttagtccactaattaaatttgtatgcgcaaactacctttgagagtatcatagatttttttggggaaagtgtttcatgtacttttaaacagatataatttcttttgagtacatttgctttttttgctgttaaaattaggattcataaatgaaaagggatttataaacctaatgtgaaaagtaatacttcatttgttctttttttgtacagtattgctgattatacaatttccgattgaaaattgttgtataatatttggagaaaaaatcacttttctcttgggagaggtttcagtgagatgtgacactggggagaatgcctcaggtattgtgaataattggattggtttttgtgaataattaggttggttttcaagagaaacagacacatgtctgtgaagatgctggggcaagagtgttcctgaagcccagagcagctaaagtaaaagtagcctctgacctgggtcactggggcccagggcttctgatcctttcttagaaaatctgctaataggtcaatgtatatgaacaatatagtggcaataagaaatgtataagactgggttccagctttaaagttgttagtggcagcatgctatagtactaaggtttgatgctttttttgaacaaaacaaacattacgagtaaccctaatacatataataatagaaatgctgtggttgaaactcaagtagaaaacccagagctagaggggcaggtatgtttttttctttctctacttccttgtactggtccctgagacacatcagaattctagtgtgtatgaaacagtttgacaactactggcatcatttggttggtgggggtagacagaaatttcagatatacaaccttccagaaaatgacttcttgtatcagccattcctaaatgtgttatctttggccaggaacatcactgttttcaaccctaaaatatgagtaaaaataatgtcgaatttttatggttgttgtaaagattaaattaattaaataaaaaattattaaagaactttttagaagagatattgatagagtagtaaataattttttttaacaacagttaatattagtgtgtaaccacaagcaattgatgttggaaggcagaggcttacttagaatctgggtatacttggccttaattctttcatattttacactatttcttggttatacaacatgttcattgctttaagaaattcttacttatggaaagcccattgatcagaaactgagataaatctcttgtatcctaacagttttatttttattctgcactaacaattggggaaattataaaatattttctcttttttttttttttactatgctttaagttttagggtacatgtgcacaatgtgcaggttagttacatatgtatacatgtgccatgctggtgtgctgcaccaattaacttgttatttaacattaggtatatttcctaatgctatcactcccccctccccccaccccacaacatgccccagtgtgtgatgttcctcttcctgtgtccatgtgttctcattgttcaattcccacctatgagtgagcacatgcggtgcttggttttttgtccttgcgatagtttgctgagaatgatggtttccagcttcatccatgtccctacaaaggacatgtactcatccttttttatggctgcatagtattccttggtgcatatgtgccacattttcttaatccagtctatcattgttggacatttgggttggctccaagtctttgctattgtgaatagtgttgcaataaacatacgtgtgcatgtgtctttatagcagcattttttataatcctttgggtatatacccagtaatgggatggctgggtcaaagggtatttctagttctagatccttgaggaatcaccacactgtctcccaaaatggttgaactagtttacagtaccaccaacagtgtaaaagtgttcctatttctccacatcctctccagcacctgttgtttccggactttttgatgatcaccattctaactggtgtgagatggtatctcattgtggttttgatttgcatttctctgatggccagtgatgatgagcattttttcatgtgtcttttggctgcataaatgtcttcatttggaagtgtctgttcatatccttcgcccactttttgatggggttctttgtttttttcttataaatttgtttgagttcattgtagattctggatattagccctttgtcagatgagtagattgcaaaacttttctcccattttgtaggttgcctgttcactctgatggtagtttcttttgctgtgcagaagctctttagtttaattagatcccatttgtcaattttggcttttgttgccattgcttttgttgttttagtcatgaagtccttgcccatgcctctatcctgaatggtattgcctaggttttcttctaggatttttatggttttaggtctaacatttaagtcttcaatccatcttgaattaattttcgtataaggtgtaaggaagggatccagtttcagccttctacatatggctatccagttttcccagcaccatttattaaatagggaatcctttccccatttcttgtttttgtcaggtttgtcaaatatcagatggttgtagatacgtggtattatttctgagagctctgttctgttccattggtctatatctctgttttggtaccagtaccatgctgttttggtaccagtaccatgctgttttggttactatagccttgtagtatagtttgaagtcaggaagcatgatgcctccagctttgttcttttggcttaggattgtcttggcaatgcgggcccttttttgtttccatatgagctttaaagtagttttttccaattctgtgaagaaagtcattggtagcttgatgggggtggcatttaatctatgaattgccttgggcagtatggccattttcatgatattgattcttcctaaccatgagcgaggaatattcttccatttgtttgtgtcctcttttattttgttgagcagtggtttgtagttcttcttgaagaggtccttcacatcccttgtaagttgtattcctaggtattttattctctttgaagcaatagtgaatgggagttcactcatgatttggctctgtttgtctgttattggtgtataagaatgcttgtgatttttgcacattgattttgtatcctgagcctttcctgaagttgcttatcagcttaaggagattttgggttgagacgatggggttttctaaatatgcaatcatgtcatctgcaaatagggacaatttgacttcctcttttcctaattgaataccttttatttctttctcctgcctgatttccctggccagaacttccaacactatgttgaataggagtggtgagagagggcatccctgtcttgtgccagttttcaagggaatgcttccagtttttgcccattcagtatgatattggctgtgggtttgtcataaatagctcttagtattttgagacacgtcccatgaatacctaatttattgagagtttttagtatgaatggctgtagaatattgtcaaaggccttttctgcatctattgatataatcatgtgatttttttctttgtttctgtttatatgctggattacgtttattgatttgcatatgttgaaccagccttgtatcctaaggatgaagcccacttgatcatggtggataagctttttaatgtgctgctggattcggtttgccagtattgtattgaggatattctcatcaatgttcatcagggatattggtctaaaattctctttttttgttgtgtctctgtcaggctttggtatcaggatgatgctggcctcataaaatgagttagggaggattccctctttttctattgattggagtagtttcagaaggaatggtaccagctccttcttgtacctctggtagaatttggctttgaatctgtctggttctggactttttttggttggtaagctattaattatagcctcactttcagagcctgttagtggtctattcagggattcaacttcttcctcgtttaatcttgggagggtgtatgtgtccaggaatttatccttttcttctagattttctagttcatttgtgtagaggtgtttatagtattctctgatggtagtttgtatttctgtgggattggtggtgatatcctctttatcatttttttattacatctatttgattcttctctcttttcttattagtcttgctagtggtttatcaattttgttgatcttttcaaaaaaccagctccgggattccctgattttttgaagggttttttgtgtctctatctccttcttttctgctgtgatctagttatttcttgccttctgccagctttttctcctgtttctcctgcttctctagttctctatgtttgctcctgcttctctagttcttttaatggtgatgttagggtgtcaattttagatctttcctgctttctcttgtgggcatgtagtgctataaatttccctctatacactgctttaaatgcatcccagagattctggtatgttgtgtctttgttctcgttggtttcaaagaacatctttatttctgccttcatttcgttatgtacccagtagtcattcaggagcaggttgttgagtttccatgtagttgagcggttttgagtgagtttcttaatcctgagttctagtttgactgcactgtggtctgagagacagtttgttttaatttctgttcttttacatttgctgaggagtgctttacttccaactatgtggttagttttggaataagagtgatgtggtgctcagaagaatgtgtattctgttgatttggggtggagagctctgcagatgtctattaggtccacttggtgcagagctgagttcaattactggatatccttgttaactttctgtctcgttgatctgtctaatgttgacagtgggttgttaaagtctcccattattattgtatgggagtctgtctcttgcaggtctctaaggacttgttttatgaatctgggtgcttctgtattgggtacatatatgtctaggatagttagttcctcttgttgaattgatccctttaccattatgtaatggccttctttgtcccttttgatctttgttggcttatagtctgttttatcagagactagcattgcaacccctgcctttttttgttttccatttgcttggtagatcttcctccatccttttattttgagcctatgtgtgtctctgcatgtgagatgggtttcctgaatacagcacactgatgggtcttgactctttatccaattttccagtctgtgtcttttaattggagcatttagcccatttacatttttaatattgttttgtgtgaatttgatcctgtcattatgatgttagctggttattttgctcattaattcatgcagtttcttcctagcatcgatggtctttacattttggcatgattttgcagcggctggtacccgttgttcctttccatgtttagcgcttccttcaggagctcttttagggcaggcctggtggtgacaaaatctctcagcatttgcttgtctgttaagaattttatttctccttcacttatgaagcttagtttggctggatatgaaattctggattgaaaattcttttctttaagaatgttgaatattggcccccactctcttctgggttgtagaatttctgctgagagatccactgttagtctgatggtcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatttgaatattggccttccttgctagattggggaagttctcctggataacatcctgcagagtgttttccaacttggttccattcttcccgtcactttcaggtacaccaatcagatgtagatttggtcttttcacatagtcccatatttcttggaggctttgttcatttctttttattcttttttctctaaacttctcttcttgcttcatttcattcatttgatcttccatcactgataccctttcttccagttgattgaatcaactactgaggcttgtgctttcatcacgtagttctcttgccttggttttcacctccatcaggtccttcaaggagttctctgcattggttactctagttagccatttgtctatttttttcaaggtttttaacttctttgccatgggttcaaacttcctcctttagctcagattagtttgatcatctgaagccttcttctctcaactcatcaaagtcattctccatccagctttgttccattgctggcgaggagctgcattcctttggaggaggagaggcactctgatttttaatttccaatttttctgctctgttttttccccatctttgtggttttatctacctttggtctttgatgatggtgacatacagatggggttttggtgtggatgtcctttctgtttgttagttttccttctaacagtcaggaccctcagctgcaggtctcttggagtttgctggaggtccactccagaccctgtttgcacggaggctgcagaacagtggatattggtgaacagcaaatgttgctgcctgatctttcctctggaagttttgtctcagaggagtacctggccgtgtgaggtgtcagtctgctcctactggggggttcttcccagttaggctactcgggggtcagggacccacttgaggaggcagtctgtccattctcagatctgcagctgcatgttgggagaaccactactctcttcaaagctgtcagagagggacatttatatctgcagaggtttctgctgccttttgtttggcaatgccctgtccccagaggtggaatctacagaggcaggcaggcctcctggagctgctgtgggctccacccagttcgagcttcccagccactttgttaacctactcaagcctcggcaatggcgggcacccctcccccagcctcactgccaccttgcagtttgatctcagactgctgtgcttgcagtgagccaggctctgtgggcataggaccctccgagccaggcatgggatataatctcctggtgtgtcgcttgccaggactgttggaaaagcgcagtattcgggtgggagtgaccggattttccaggtgctgtccatcaccacttcccttggctaggaaagggaattccctgaccccttgtgcttcctggatgaggtgatgcctcaccctgcttcgcctcatgctcagtgggctgcacccactgtcctgctgtctgacaagcccgagtgagatgtacccggtacctcagttggaaatgcagaaatcactcatcttctgcgtcgctcatgctgggatctgtagattggagctgttccgattcggccatcttggaacacagagccccaggaaatttttttattttctggattcaggtgaataatgacaagaccccacaatttgaaaagacgtttactgttgttccttgcaccaacttttttcacccatgaattattcttgacctcagtgctgaaagagtaagtatgcaataagactaaaagggcataatgcattcaataagaatgctttttaatgaatgccaggtgcccagcactatgatggacatcatggcacacaccaaaaaagtgcaaaagaaaatcttatttattctgaaattaaaagtatataggaatggaggacatacatgtgtgaaataatttgataaggcatgtctgtgattctcaaccatgttatttactctacataaaaatacatatttctgcacctcccattttacctctccactttatccttatttaactttaaactagattttcaactttaggcttgaaacatcatttttttctggaagaccttatctagttcctcagggtagatgttacaacagtatgttaaaatacctctctgaatttttatattttttatttttgcaattttttcaatgtccatcttctggtataagtgtattctacacagcgacagggactgtattgaccattggaatacaccagtgaatagcacttgtcattagtgagtacatgaaggtttaagagatcatttatgccattccccttatttaagggagtcaacaaaagttaaatgatgtgttgcacagacaggtgtaacagacccaccactacaatcacagctacagaccttctccagctgtcctttccactccaacatgatgcttcccctgcattatacaagaggatataagacagaatgagcaaaggaggatgttttccaggggagaaaagagtgaataggcaggacttatttgggaattatgggagatctttgctcttttttaaagcactcaacatttacaccaacagatgagcaaagtacattaagtatagtatgaaatgtaccagtcatttcccactaacatcttcaatcagagtgtccacaatcttcctttaatacttaagtcagactccatttttcatgggaacacaatcttgtttcccatttataaacaatttttttctctagaccttgtgttaaaatgatccaaaaatttctccattacatatttttaagctcatttaatacttacattttattctacttaagaataaagaaacatatatttggtcagatttttctggaaaaaatcaagttcttttttagaaaacagacttaatatatgtgaaaatttggatcatttaaaagttggaaataactagaaattaataaagagaaaaatatgtgttaaaatgttgcaacttcaaagcaaacagaaattttagtttttcttctcggcagatctgaatattgcaaaaatatttcaagtttgtagaaataattaaaacattcaaaaagaagtaacacaaatattaatatcagttaatgaagagaatttcaaagaacttcaaggaaaaatttcaagagcatacaatttatgtaaatcattgtcttctaaatacagaaacagtatgtgaatatcctaaaacattgtgaaaagaagttatctaaaaagcaatttggaggaaagagactattccaatgaacattttgcaaactgggaagatgcaaccttctgtgtaaaataaaggtgtgttccagaggacaaatgaagggtttggcttttatagagaaagttcccactcagattccaaattaggtccttttaagcaaataaagggtccagatttacttaattctggttgttcagcacagttgggttctgattggaggatgcacgccacagcctatctgttggtttaggtgatgtaaacaggaatagtcaggtataaaattctcaaagttaggcaagtgtgtggattttctggtaactcagagtaatgtgtgacctctatttagcaaatggccattggcttctttttaaagttatgcccagttagccacccaggctttctcatgaaggatgggttctttccagttctctgctttcagggactctccatatcttgcataacttttctttttgcttgttttctttcttctcttctcaaaaacctttcattaatggcaatgcttcatcccttaggaagaatgtcatatcaccgagcacagaaatttcaggcaggaagaggtttagaattttaaataatcaacaaggaaatttacataacaggagaaggaagaaatttaagagtctagtactaaaaagcttctccttctaaacccataaaacgttcacacctatttgctattttgacccagaagggctaaaagaaactaaataaaactactctacttatggagttaatctaacaaagtaatacgtatctattctgaattttgaagataaccttttaggtgatttgattttctgttggataaataaaacaagcatgctccaatgtcacacaacacacaaaagtgaataaaagggaaagttaacataggctggagatgagtactggtgagcgctcttgacaagagaagctcttgatgaattttaatgtatggatggcacattttattattttatgatgtcacttagacaaaaaattaaagcagaatggagagctgaatttgtgcttgttatgatggaaatcagagagatatgttggggtgtaactgtatatcatgagaagattgcaattatagatgatgcaatgaaagatgaagccgaagcatggttgctacatctaacctgaagtgcatgatgacaatgctaattttgtggcctcaaacataataaaaaccagtgcatccctcacctgcatgtttactcagaaagcatttagtgaaggcttaccatactcaaagcactataaaaatcttcctaggagaaacagatatggcaccaagggacagtgactgatttcaggttcatgatatattagctgcaccctggttagcattattcactctccacaaccaggaaatgtagtttgacagtggcctttctgttcagtttatttatactttctcatgttcaatttttattttaatcagtacaattttttaaagaagcctaaccaaaactaagaaagaagggtatggctttttagaaagcaaagacaaatagcaggttaggaattaaaatgtccacgtagaatttactgatatataaatcattgtattagccaagattcttttcattgcaaatgacaaacctttgaatacatttactttagaccaaatggaaagtttacttgtctgtagagcccacaggaatggttaaataatatgagcagggaaaccatgataaaaagaaattttgtggccaggcgtggtggctcatgcctgtaatcccagcactttgggaggccaagatgggcagatcacaaagtcaggagatcgagatcatcctggcaatcatggtgaaaccccatctctaccaaaaatacaaactacaaaaaaaattagccacgcgtggtggtgggtgcctgtagtcccaggtacttgggaggctgaggaaggagaatggcatgaacccaagaggcagagcttgcagtgagctgagatcgtgccattgcattctagcctgggcgattgagcgagactccaactccaaaaaaaaaaaaaaagaaagaaagaaattttgtaaggatttgaactgtggactcaaatgccaacaatgctgtctgtatctctctttgattggtttctgtcagaataccagctcaatttttatcacactcagtatatttatattgtggaaaatataaacatttattgttcacaattttatagtctatgacttgaacaaccaaatagatttcttcattggcctcatggatactacacttgctaaaataatcccctctagtaaatgtcatgggccacttagtgtatcgcaaaaattctccaataataaaatacataaataaaagtaatattttggttgtcatcttagtccatttgcactgccataccaaaataccacggactaggtgacttataaacaagtttaaaaactcacaataagtgaccagatttttttctcttagaccaatgacttgcaaccaagtaagaatgcagtgtctttcactggagcctcttggttggagctgagggagaagcactttcttaaagaaggggttggaggtgtgaaaaataaaaacaacctactagattatgtgtttgcagaacaatattcatcatgttattcagttcctctcataaaaagattcaaatgataaatgctcataatttaaaactgaaaaaggacttttttccccaaagctatttttattgggcaataaaatgacagagcccattatttttcctatttttgctgttgctaccagaagcttcagaattaaatcataatataacatcaataaccaacttgcatcaggtttatggaaaccatttccactattttctataaggtttttaaatttttctaatttttaaattatttctgtgcctttaaaatgcttttggattactttcagaaacagatgaagaaaaataagtaagtaattgacaaagaactcacaacattggcctcatgggtactacacttgctaaaataatcccctctagtaaatgtcatgggccacttagtgtacggcaaaaattctccaataataaaataaaatgcataaataaaaagaatattttggttgtcatcttagtccatttggacttccataccaaaataccatggactaggtgacttataaacaacataaatttacttctcacagttcatgatttaaaatacaaatgtcattaggtcataaacacagtagaataccttcaaccactcaagcttaattggtatgttccatctcacagacaacatgcttaaatacattatttaatattaattattacagactggtttaaaatataaaatcttcaagaaatactttaatttcccttggtgatggaaagtctatccctctgaaatataacaccttccaatttcctgtctctctacacaatgcagctgtggggatttttgagaaagtgacaagaaatgtcttcttgtccttgttgacagggttttatggtgattgaataatattttcagtttaaatatgtaaaacacatattacttcagtaaaatgcttagtacttgaaacctaccagaaaaaatgaaggtaatataaatcagtgcatagcagtttgagttgaattgtgatttaaattctcctgctctctcatagaggaaaaactgtgtagacagtagttttacatggacctcatcccagtttcaccatgtctgataacaaaactaatgcaaagatgcttctagtcataggcctgtgtcctctaaaaataagaaaaattaattgtgactgttcatctttccaagacaccccattcctatgcttctgatatgggtaaatatttgtaagagtattagcaacaaaacatgaataagccccacctccactctcaaaggtctaaagctggaaaggagtagtgaaattgaaaagagactaaaatctattaaacatttactataaacaaaacactgtgttaagtgtttggattatatataattcctgagtttatagagactgattcttgtaaagaacatcattatttaaatttaaaaataagtataataaatgtataaataagaaataaatattattataagtttttctatctggggtcagtgaactaaagctcatagacaatctcatctacaaaccattttcatgtagaccacaaactaagaacggtttattaaatttttaagaattgcattaaatggttatatgggtacctgcataatatatttgattttgcctaatggctcacaaagcctaaaatacgttctatctggccctttacaaaaatagtttatagatcctattctatagagatttgacctagtcagaatagtaaatagtatagatgaatgacaaattaagaatataaataaaacattttattaatatatttttatcagtaatttcatagaaaaatatacactcagaattaatgtgaaaatagattacttagttatttggcatatgcaactaagtggaaggccatatagtatgctggattcttgtcgtgtgtgacgtggggtcttggatattaggctttttgacatatatctattgcagaagcaatttttatggaaataaagtatattagtctgtgctcacactgttataaagaaatacctgagactgggtaattgatcaagaaaataggtttaattagttcacagttctgcaggctatacaggaagcatggcagcatcttcagggcggtgggactctgggcctggcccacaaaaccattctttcctcctaggcctctgggcctatgatggaaggggctgccaaaaggtctctgaaatgcctttgaaacttttcccccattgtcttggctactataattgggttcctctttacttatgccaatttctgcagcctgcttgaattccttcttgaaaaatcggcttttatttgctaccatatggctaggttgcaaatttttcaaacttttatgttctgcttctcttttaaatataagttccagtttcagatcatttctttacttctgcatatgatcataggctgttaaaggcagctaaggcaaatcttgattgctctgtaaattagaaatatcttctgccaggtatcctaaattattaatctcaagttgtaagtttcacagatctctagagcagggtacattacttccaagattttgctaaagaataacaaaagtgttttctccagtttccagtaagttcttcatctccatctgagaccccctcagcctggacttcattgttcatatcactatcagtatttttgtcataacaattgaacaagtcctaggaattcccaagctttctctcatcttcctgcctttttctgagcccttcacacactatcaacctctgcccaataaccagttccaaagtcactttcacatttttacatatctttataattatgacccactcctgatactaatgttctgtattaatctgtataaaaaatacctgaaatggggtaatttaaataaaagaggtttaattggtgcatggttccacaggttatacaggaagcatggcagcatctgtttctagggaggcttcagggagtttttacttatggcagaaggcaaagctaaagcaggcatttacacatggctggagcaggagaaagagagagtggggaggggccgcatacttaaaaaaaaaaagatcttgtgagaactgactcactatagagtaccaagggggaatggtgctaaaccattcaggaaaactgctcccatgatccaatcatctaccactaggccccacctccagcattgggattccaactcaacatgagatttgggcaggaagacatatccaaaccatatcatagagtttttcatagaaggcatccctgtagcatgggatgaagttcaatttaaaaaaaaggttgaaattattgtagaaagcaaggtaacttacttactgtcttactagagaatcagcaaagctcacaatgtccttggaggttggaataggagactgagtttttggataggcctgctgaaacatgacagcaggagtggtggaggaagaacagaggtctctagggttgcaatgaaagagatgttttgctttctctatatatcttctgatataaaataaaaattttgtcagtgtaaaaagaatcatattattaagactatcaatcactaaaataacaaagaacaaaatcaactattgtgatatcactgatgatatttgggaaagttcgtgtttctctttcacttttgaagaataacttcatgagtatggaattgtaggttgatgtttgcttttacctctcagtaaattcatttactttgaatattttccttctctctagtcttactcacatgatttctgagcagaagtcaaatgcagttattatatttacatcactatagttaagatgtgttttattcctctgtgtcctttcagaattgtcctaaatctctgatttttccttaatttgaaaatgatatgctgaggtgaacttttttagcattaatcctggttggtgttctttgagcttcttagatctgtagtttggtgtctgacattaatttaggaaaattctgtcatcattatttcaaattttttttctgcttttttttctctcatctctgtctggaattcccattatgcatatttacactttctgtagttgtcccactgattttggataatatattctgttttttttcaacctttgttccctttgcttttcagttttggaggtttctattgacaaatcttcaactcagagagtctttccccaactgtgtccagtctagtaataagcccatcagggacattcacagtgtttgtatctctagcatttctctttggttctttcttgggatttcaatctctctgcttatatttcccatctgttcttgcatactatctgctttatccatcatatcccttaatatattaaacatagttcttttagatttcctatctgataactctaaaatccaggccatctagttctggtgttagctctttctctttaaagtgttttgtgtctgggagtatgccttataatttttcctgagagctggacatgaagtagtgtattaagtaaaccacagtaaatagttctttagtattgtgacagtaaggttttaggagatgaaacattttctgtagttctacagttagatctcagtcttatagtgagcctgtgcttctggactgtaagccttacaactctttttccatttttttttctcccatcttaggtgaggcaagatggttagagtgggctgaagtttggtatttccattctccctcatgacaaggtagagcaggctggagttgagtattttattcccccagtttagttagcctttgctcaaactgcagtaggttagtatctggttaactaatttatcctgacaagagattaaaacaacaacaacaacaacaacagagtgttctagtatatttcaaagtggtctcttttttttcttcccctgctggaagcatgaggaaatttttctcctatatttactgtggctaagctcctggaggtaaaacttagaaaagggcggtgtctgttctgactaggtcaccctggatgtattaacagagacatgttcacacctagtctccagcgagttatcaatcatagttcagggtttcctaccttgacactggttcccattaaggcctctgttttaatatgtggtgattctctgtatttgcctgcttgtgtcttctattctgggcacagtggtttgctctgtggatctaagaagagttgttatttacttatttttttgtttgttcagtattttactttgtttttacaacagagtggtggcttccaagctttttcaatgtagaattggacagcagaagtcccatattattttcaagtgcccatgtaatagatacccaattgagccatattcttatcatagcacaaactttaatacatttaaggaattgaaatcttgcagaataatgtatatcgtaacaacagtggaatctaactagaaatgaataatagaagattacagaaaaatctgaagcacttggaagcagaacagcacatcctaaataatccatgggtttaaaaggaagcttccaaggaaatctaaaatcacactgaactgaatgaaaatgaaaatacaaattataaattgtgagatagagctaaaacagtgttgagagagaaatttatagcattgagtacatctttaatgaaagagaaaatgtattcaatcaattatccaagctcccatctcaagatcctagggaaaaataaaccacatgacacagaacaaaaataaaaaagttaagagagaaaattaagaaaacataaatactaaaacaataaagaaacatgatgaaaaaatctgatacaaatatcactaaaacttccaaacctctagaaaaacataataaaaaagagagaagacacaatatcagaaattaaagagaggatatcactactggctctataggcatcaaaagaataatactaaggatagtaatgaacacataaatacaaaaacttagtcaaaatagatacctacattacacctatatgatgtagattatttcaacagggctatgattattaagaaaattgaatttataattttcaatttttaaagaagtatccaggccaaattggatttgctggaaaattctatcaaacatttaaagaattaacaatgttacacaatttctactagaaaatagaagactaaacactccacaattttaggaatttaatattactctgataccaacatcagacaaagacagtacaaagatagaaaacacatatcaatatgccttataagaatggactcaacagtctctcacaaaatattagtaaatggaattagtaatatataaaaagacattcaccatgaacaagcagggatttttccatgaatgtaagcttagttccatatttgaaaatcaatcaatataatccatagtataaaccaaaaaagagaaattacattaccgtaagaaataacgtagaaaaaattgacaaatttaacacaaatttgtgataactctcagaaaatagaaattgaggggagctaccttaacacgatgaacagtatctacagaaagcctggagcttatgttatgcttgatgatataacactgtttttcccctaagatatggaatgtagcaaggatgtctactgtgaaattcttattcataatagtgttggacaatcaatacaaaagataaggaaataaaagtcctacagatgggaaaaaaagaaacaaaactgttctcaatttcagatggcatgcgtttctaggaagaaaatctcaaggaatatacaaatataaattatagaactaatatcttatctcctgcaaccttcagtaaagtcaccagatataagataaacatttagacatcatatttaaatatattagcaataaatacatgacatcagtatttaaaatgtgatattacttacaatcactaaacaaaatttgaaataactctaaatctaacaaaccatgtacagggcttgtatgcagataaatacaaaatactgatgaagcaagcaaggaagaactacataaatggaaagatatgtgtgtttagagattgaaggaatcaacatattgaagatgtaaattctccctcaagttaacatactgatttagcacagttctcatcaaaatcccagcaatactttttgacatataggtaatattattgtaaaatatatctgtataagacaaaatattagaacagctgaaacaattttggtgtgtaaaaataaagtgggaggaatcagtctatctggttttaagactgattagatagttgtagtatccaaggctgcatgaaatttttgaagagagagacacacagatcaagagaaaggatagaaaaccagaaatagacttatgcaaattctgctcaagtgatttttttttttttgcaaaagtgaaaaggaattcaaaggaaaaaagataacattttaaacaaatagtgtaggggtgactggacatccatgatgaaataaataaaagaattaatttttagaaattttgcctcacattttatacagaattaaaacaaaatgtatcatagacttaaatgtaaaatgtaacactataacattttagataaaaattcatcttcatgatatgagatcaggtgatgagttttttaatttgacaacaaaaacaggattcataaaggaaaactgattataatttgaccttatcaaaattaaacaaatttaatgtgaaaaatcctggcaagaggatgaaaatacaagccagagatgcgtagaaatacttaaaaaacacatatctaacaaatgggctagtttatagcatgtgtaaataactctcaaactccctagcataaaaagaaacaattcctgcagagtgcagtggttcacgcctgtaatcccaacactctgagagtctgaagcaggccgatcacttgaggtgaggagtttaagagcagcctagccaacatggcaaaaacccttctctactaaaaatacaaaaattagccaggcatggtggcacatgcctgtaatcccagctattcaggatgctgagggaggagaatcatttgaacccgggaggcgggggtcgcagtgagtcgagatcgtgtcacaacactccagcctgggcaacagaataagtagctggtggaattaaattgtcaatcttctcctagtaagaaagtgattgaaggtggtaacagaagaaataatcttgggagataaactgaaaatattaactgctttatgttcttagtcaaaaattcagaatttacgcagcatgctaatccctatagattttctgtttgaacaaaagtgacaatgatctaatctttaacaatactcaaaaatgttacaaaactccttttattcaaaaatctactttgcaattgtttctaaatgatttccaaaaatcctgtcagtcgttaacaagagtaaatcttaaatacacataactttatactatctccttgcattatgttctttcgatttgacattctgagtgtcagaatgatttaacttaacataaattacatcaggaatatttttatattgtacttggttgtttacatattaatgacattgacacaaaaaaatacttgttttaattcaatctttgtgaaaagacattactccaaaaggatattgaccttccacttgctatctagggtgacgtctgcagtaaagatttggggaatggccatttccttaaatgctggctggccttaatgcaccctcagatattctatgtcccataataatagccaaggtatgggaatgggatttctaatatgtagggtaagaaaggatgacaggtctgctttactagtaggagaatctcattttgggtagtggaggatataaaaggaaaattaatccagacattagaaacttggaagatttcattattgtaatgaagccaacataggaaatgtgctacattaatcctgctgaggttaaatatttctgagaaaatgtgtgtatttcaggaaaaaatcttcactgaaaatactttagagtcatttcttaattgtgcctcttctcatccattagatgggagtgaatatttaattcatttaatggattaaagtaccaataccagtaaaataccaataatctatattagggattttaaaaagtggatagtaaagttcatatgtaaaaacagataagaagagctcagaaaacactgtaagagaaatctgtgaagggggatttgccctaaaaggtaaaaacaaaccaatacaaaatctgtataataaagccagtgtggtatcagagcagaaataaacagaccagtggaatagaataggaagtctgtaaataggcttatgtgcatatgtcactttttttataagggataagtggcatttcaaatcactaacataaagatgagcatttaataaagggtgctggagcaactgggtagccatttagaaaatgataaggttagatgtacatctaacatcatagacaacaataagctccaaatggatgaggaataaaatgtaaattaaaatcataaaagtgtgaggaaaaaaagatgggtggatttgtctctgaacttggtatagggaaaatgttcctaaggataactcaaaatcagaagcaatcaaataaaagattaatgtattttactacataaaactatttaaaatgcatgccccaaagaccgcaagaacagtcaaaagataactgaaaaacagaaagtatatgtaacatacaccatggttgaagggctaacatcaccattatataaggaattcctaaatgttaagggacagagtagtaaaacttagaaaaatggaaaaccaaatattatcagacaaatgataaataaatattttaaaataaccttcaaaaaggtaaaaagtaaaaactaaatcatagtaaggaaaatgttatttaaaacaaactaagatactattttctatttattatataggtgaaaatttaaagtgtcctgttggtgagtctggagaaacaggtactctcacatattgctggtagaaatgatcatcagtctaaaagtgtaaaagggacatttgaatacacacacatacatgtatttctctcttctctctttctctcaatgatagatagatagagagatagatagatagacagatagatgaatgatagatctatattcttgctttctgaccaggaatcccacttctaggaatctaccttaaagacataccccagtaatacggaaatacataagcctaagatcatttgtgttttattcacaatcacaaaatattaaagacaacctaaatgaccatacttaggagagtggttgaataaattatggcacatctacacaaaagagtttttggcatgagggcaagctctacgcactgagccgggtccatgtataggatatgttattaagtgaaaaaagtaaaatgcaaaagaatgtttgcagtatgctacctctcatgtaaaaaaaaggagtttatatatttatatggttccatttatgtgaagtgttcaaattagtcacactgacagaataagtagatttgtagttacctagagctggagtggaggggatggggagtggatgttaaatggctacaaggccattttgggggaagatgaacatgttctaattagatcatagggatgcttagacaactctgctaatacaccaaaatccactgaattgtatagactttgcagaagtaaagttcatgacatgtagattatatagtactaataaatgttctaaaatttagaaaaaacagaggatttaagaaaacatatatgtatcagattttttgtgccaaaaaatatagggaggaaaaatcacactttaaagagattgattacctattgaggggatggaaatataggagaagagtgaaaacaaagggagaaataaatatagaatattaggaatgaaaagaaactatcacacttctgaatatacatgggatatgggatatagtttggatctttgtcttcatccaaatttcatgttgaattttcacccctaatgctggaggtaggacctggtgggaggtgtttggatcatggaggtggagccctcatggcgtgatgctgtcttcatgatagtgactgagttctcatgggatctagtggttcaaaagtgtgtggcactgccttccctaccacactctctctctctcttgctcttgctcctgctctttccatgtgacatgcctgttcccgctttgccttctgccatgattgtaagccccctgaggcctcccagaagcagaagccgctatgcatccagtggggcttgtagaaccatgagtcaatcaaacctcttttcttataatttactcagtctcaggcatttctttatagcaatacggtaatagactagtacaatatgtttgtatatttttgacttgtagaactatagtagttgttcacatacttgaaaaataaaagaataaataaaatcaaccacaatatgtgggaagtacaaaatcaaatacaaatattaaaaatgaaactagctgtattacaaacgaaaaacataagcacacaaaaatttgggaaaaagtgaactaacctaaataatttcaggaagcaatagtttttgactggatattctaatgctaaagatgaaaataattataaataaatattgagctctagttagtaaagttgtttctcagagggttatgtgtaggtgattctgaaaccatgtgtagactaggattaatcaaagaataaatgtattggaagtaattagagctaagtgtctcaatattgaagaaagaattaaaagaaagggaaggttagaaaaaacactattttggtggaatggcattatagttgtcagtatgaactcttggtttataatatacacatacataggtagatatagaaataaatatagctgtataacaatgtgtggattagtatttatatctctgtttctatctactgaatctatttctctatctctatatctatctttctatctatctacatataatctatctatttcctaggtctatatgctaaaagggcctaggaaaatgatgtcctggtagcaatgaggacaccaaacagagagctctttgtttctaagtatcattctccacttcaaaatgaagaaacaacaacaataaaccagagatttgtggagaagtggttgatctagacctagcactaggaaagtatgagatgagcctggaaattaattgttcataaagaataaggaaatgtcaaaacctgacagagatcccattggccaaaccaggcacaatctgagcaacaaaataagtactgacagtgttggattataactcataaaatagaggtccatgaattggtcataacttaactaaataatggaataaatgaataattcatcctacaaaagaattctaactaatacatatagaaggcacaagggagatacagaaatcatcattaagtaatcattaatgcaggcaagatccactgctgaatgctaatgtgagtaaacagaagtatgaggaaaagcaaaatatttgaatagtctcaaagtacctatctcaagatatgtattagttacacaaggggaaaaatagtaactttaggctgggcatggtggctcatgcctgtaatcccagcactttgggaggccaaggtggacagatcacctgaggccaggagtttgagaccagcctggcaaagatggtgaaaccccgtctctactaaaaaaatgaaaattagcagggcatggttgtgcaaacctgtaatcccaggtacttgagaggttgaggtaggcgaatcactcaaacccaggaggtgaaggctgcagtgagctgagatcatgccactgcaccccagcctgggtgacacagtgagactccatctcaaaaaacaaagtaactttatagtagagaaatacagcaaacaaaacttataagcaagtaatgatgcttaacatcaccagtaacaaaacatctatatttcacaaatcctaatatggtacactgaaaagggaacacctctgttgtattctcatatcatcatcccaaccacaagtaaataaataaaagcaagaagcataacctcaatataatcatgagaaaacatcagagaaacccaaactgagagacattttacaaaataactgaggagtacacataaaatgagtcaagtcataaaaagacaagaaaaaacctggagattgtgtcagaaattggataagactaaggagacactactaaacacaacatggggtattgatttatatcctgaaacatgagaagatcttagtggaaaaagtggtaaaattcaaataagacattgcagtgggataattaaggaatcagagagaccgaggggttgaggaggaattatttaattatttatgtgcaacaactcagttggattaacatccaaaggactgagccccaaacaaagagtccggttaccttttaagcattttggggtggtggtggtgggagatctgtgcagggggaagcatattacagaagtgagaaacaaagacagttattcaattaagacatgcattacatcatttcttacttttcaaggaatagcatgttttacgacttgagtttatctgcctagtgaccttgcagctgcacagctagagaaacaaggtcttcacaatgcctgggaaggggagagataaggctcactagccacagaaaagcaggcagttaattttaaaggactccagctctttctcttcttcagggggaattgggttttcttacatacaactgagtttttgcttacattctttaatttgttttaattcctgttccaacatgttacttggtcaatactgctgaaccaatttaattttcctaaatgtatctttgttatgtaagttgctaccatgaggagcagtgaggtgaggggtacacatgaattctccttattaactttgcaacttttctgtaaacataatattatttcaaaataataataataagaagaatgaggtgctttttacattttggagattcaaaagttgagcaaagaaaagggaatgcaaactgcccaagctgaaacagttgtccatccgtgatttaaaatccaaaagcctgaattcaaaagccattgtcctaaaacattcacacaatgtttagaatgatgaaggcactcaataactgaaggcatttataaattccaatacctcaaactacatagaaatttcatatgaaccggagagcagttttcactgggtgtcagtggaaatgcagtgagaggttttgtggtggtccaaaattacttgaagcattggcagtgggaaagggtcaagaatgtgaatagctcttcagagcatggaaagatgagcataacaacaataaacacatctaaagaccaattgtgaattgtgaatcaccaactggggaacactgaggaaccaagaaaggcattctaaatctgaaaaagttgagtttgtttattagatcaacacagacaaatatgtgtagtgtttccaaaggtagactagcaaggtgctgtcttcttgctgaactttaaagctaattgtcagatgctaaagtttggagtatataatttgtattcaatttagttacatgtttggagaaaagattgtcaattattatgattattccttagtatttaataaaataataggtgatacttttatttggcccatatttgtatattaaaattagacatctataattgaatcagacctcaaacctatattttgattatttaatctaaatgttttccaatcggaaaatgttactttttcttctcatcttatagcacatggaaaaagcaccacactaccctgacaaagacgagaaaaggaactcaaggtgcctcagtgatgcagaatgttatcttcatgcaatcaggttcccttcgcaggtgtgctgtttgtgggattcactgtcagctcccattaattgtatctcctatattccttgtagatggttccctcaatggtgacagcttgttttagcagtagtcctattaacagcgactctcacaagaaatatcctcttcaattgaaatggcttccattcagaacaactcttagttttggcattctgttctatccataatgaatatagctttccccaactagcactccaagcaacatgtgtcatatctccagtgtctctcacctccttacacatgcctaatttcttcacagttaactctcgctactccaaatggatactgtagagtcttttagaaatgcagaatctcaggctctatgctagatttgctaaatcagagactgcattttaacaagatccccacatgatttatttgaccatcagtttaagatgcactgacctaggtgaatcagtgtggcagttttagtaccatattcaaaggccagctcatattggggtccctgaaaagtttttcagcgacagcctgctgcaaaacttctacaaactatgcagaaagactctagactaaccagatattcaaaaaaatgttctaatcaaaattccttacatgtcatttaaaacttgatttttaggccattatgtaaatacctatgattttactttttgtaaaaaaattctgaaagatgccatcacaaaatgtgtttgcttgcactagacaataagctctttcaagaccagtgtacatgagttactgagatagctgaatataaaatactgatttggaaggaccttcaaagattttgttatatattgcttccactttctgaagatgttttaatacttagtgggcatttggaaaagaccttcaaatagtcacctcactcaattattaattatttaatgtacacaacagatttacttccagtcagccatgcttttattatctccttaaaaatattattctatattatccagaatatttgattcttctcatagacatattttaaatctttaagactgtgaattcaattgaagtctatccaattggaataataattaggatttctccttaagaaacttacgcatgagaggtggagccaagatggctgaataggaacaactctagtctataactcccagcatgagtgacacagaagacgggtgatttctgcatttccaattgaggtactaggttcatctcactggggagtgttggaaagtgggtgcaggatattgggtggagtgcactgagcatgagccaaaggcattgcctcagccaggaagtgcaaggggtcagggaattcccattcctattcaaagaaaggggtgacagatggcacctggaaaattgggtcactcccatcccaatattacacttttccagcagtcttatcaaatggcacaccaggagattatatcctgtgcctggctcagagggtcctacgcccatggagcctcattcattgagagcacagcagtctgagatcaaactacaaggtggcagcgacactgggggaggggtgcccacaattgctgaggcttgagtaggtaaacaaagggccaggaaactcgaattgggtggagcccatcacagctcaaggaggccagcctgcctctgtagcctccacctctgggggcagggcattgccaaacaaaaggcagcagaatcctctgcaacttaaatgtccctgtctgacagttttgaagagagtagtggttctctcagcatgcagctggaaatcagagaatggacagactgcctcctcaagtgggtccctgacccccaagtaacctaactgggaggcaccccccagtaggggcagactgacacttcacacagccggttactcctctgagacaaaacttccagaggaatgatcaggcagcaacatttgctgttcaccaatatccgctgttctgcagcctctgctactgatatccaggcaaacagagtctggagtggacgtccagcaaactccaagagacctgcagctgagggtcctgaatgttagaatgaaaactaacaaacagaaaagacatccacaccaaaaccccatctgtacatcaccatcatcaaagaccaaaggtagataaaagcacaaagatggggaaaaaacagaggagaaaaactggaaactctaaaaatcgagtgcctctcctcctccaaaggaacacagctcctcaccagcaatggaacaaagttggatggagaatgactttgacgaattgagagaagaaggcttcagatgatcaaactactttgagcaaaaggaggaagttcaaacccaccaggaagaagttaaaaaccttgaaaaaaaattagacaaatggctaactagaataaccaaggcagagacgtccttaaatgacctgatggagctgaaaaccaaggcaagagaactacgtgaagaatgcacaagcctcagtagccaattcgatcaactggaagaaagggtatcagtgatgaaagatcaaatgaatgaaatgaaacaagaagagaagtttagagaaaaaagaataaaaagaaatgaacaaagcctccaagaaatatgggactatgtcaaaagaccaaatctacatctgattggtgtacctgaaagtgacgggaagaatagaaccaagttggaaaacactctgcaggatattatccaggagaacttccccaatctagcaaggcaggccaacattcacattcaggaaatacagagaatgccacaaagatactcctcgagaaagacaactccaagacacataattgtcagattcaccaaagttgaaatgaaggaaaaaatgttaacggcagacagagagaaaggtcaggttacccacaaagggaagaccatcagactaacagctgatctctcagcagaaactctacaagccagaagatagtgggggccaatattcaacattcttaaagaaaagaattttcaacccagaatttcatatccagccaaactaagcttcataagtgaaggagaaataaaaccctttacagacaagcaaacgctgagagattttgtcaccaccaggcctgccctaaaagagctcgtgaaggaagcactaaacatgcaaatgaacaactggtagcagccactgcaaaaacatgccaaattgtaaagaccatcaaggccaggaagaaactgcatgaactaatgagcaaaataaccagctaacatcataatggttattttattggatcaaattcacacataacaatattaaccttaaatgtaaatgggctaaatgctccaatgaaaaggcacagactgacaaattggataaagagtcaagacccatcagtgtgctgtattcaggaaatgcaactcacatgcagagataacacataggctcaaaataaagggatggaagaagatctaccaagcaagtggaatacaaaaaatggcaggggttgcaatcctagtctctcataaaacagactttaaaccaacaaagatcaaaagagacaaagaaggccattacataatggtaaagggatcaattcaacaagaagacctaactatcctaaatatatatgcacccaatacaggagcactcagattcataaagcaagtccttagagacttagactcccacacaataataatgggagactttaacactcactgtcaacattagacagatcaatgagacagaaagttaacaatgatatccagtaattgaactcagctctccaccaagtggacctaatagacatctacagaactctgcaccccaaatcaacagaatatacattcatctcagcaccacctcacacttattccaaaattgaccacatagttggaagtaaagcacccctcagcaaatgtaaaagaacagaaattataaaaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgtccaaaagagaaagcaggaaagatctaaaattgacaccctaacaacatcattaaacgaactagagaagcaagagcaaacacattcaaaagctagcagaaggcaagaaataactaagatcagagcagaactgaaagaaatagagatgcaaaaaacccttcaaaaaatcagggaatcccagagctggttttttgaaaagatcaaaaaaattgatagaccactagcaagactaataaagaaaaaaagagagaagaatcaaatagatgcattaaaaaatgataaaggggatatcaccaccaatcccacagaaatacaaactaccatcggagaataacataaacacctctatgcaaataaactagaaaatctagaagaaatggataaattcctcaacacatacaccctcccaagtctaaaccagcaagaagttgaatccctgaatagaccaataacaggctctcaaattgaggcaaaaattagtagcttaccaaccagaaaaagtccaggactagatggattcacagctgaattctaccagaggtacaacgaggagatggtagcattccttctgaaactattccaatcattagaaaaagagggtatcctccctaactcattttatgaggtcagcatcatcctgataccaaagcctgatagagacacaacaaaaaaagagaattttagaccaatatccctgatgaacatcgatgcaaaaatcctcaataaaatacaggaaaccgaatccagcagcacatcaaaaagcttatccaccatgatcaagtgggcttcatccctgcgatgcaaggctggttcaacatacagaaatcaataaacataatccagcatataaacagaaccaatgacaaaaaccatatgattatctcaatagatgcagaaaaggcatttgacaaaattcaataactcttcatgctaaaaactctcaataaattagtaggtattgatgggacatatctcaaaataataagagctatctatgacaaacccacagccaatatcatactgaatgggcaaaaactggaggcattccctttgaaaactggcacaagacagggatgccctctctcaccactcctattcaacatagtgttggaagttctggccggggcaatcaggcaggagaaggaaataaagggtattcaatttggaaagaggaagccaaattgtccctgtttgcagatgacatgattgtatatctagaaaaccccattgtctcagcccaaaatctccttaagctgataggcaacttcagcaatgtctcaggatacaaaatcaacgtgcaaaaatcacaagcattcttatacaccaacaacagacaaacagagagccaaatcatgagtgaactcccattcacaattgcttcaaagagaataaaattcttaggaatccaacttacaagggacatgaaggacctcttcaaggagaactacaaaccactgctcaatgaaatgaaagcggatacaaacaaatggaagaatattccatgctcatgggtaggaagaatcaaaatcctgaaaatggccatactgcccaaggtaatttatagattcaatgccatccccatcaagctaccaatgactttcttcacagaattggaaaaaactattttaaagttcatatggaaccaaaaaagagcgcacattgctaagtcaatccaaagccaaagaacaaagctggaggcatcacactacctgacttcaaactatactacaaggctacagtaaccaaaacagcatggtactggtaccaaaacagagatatagaacaatggaacagaacagagccctcagaaataatgctgcacatctacaactatctgatctttgacaaacctgagaaaaacaagcaatggggaaaggattccctatttaataaatggtgccgggaaaactggctagccatatgtagaaagctgaaactggatcccttccttaaaccttatacaaaaattaattcaagatggattaaagacttaagtgttagacctaaaaccataaaaaccctggaagaaaatgtagacaataccattcaggacataggcatgggcaagaactttatgtctaaaacaccaaaagcaatgacaacacaagccaaaattgatgaatgggatctaattaaactaaagagcttctgcacagcaaaagaaactaccatcagagtgaacaagcaacctacggaatgggagaaaatttttgccatctactcttctgacaaagggctaatatccaaaatctacaatgaactcaaacaaatttacaggaaaaaacaaccctatcaaaaagtgagcgaaggatattaacagccacctctcaaaagaagacatttatgcagccaacagactcatgaaaaaatgctcatcatcactggccatcagagaaatgcaaatcacaaccacaatgagataccatctcacaccagttagaatggtgatcatcaaaaagtcaggaaacaacaggtgctggagaggatgtggagaaataggaacacttttaccctgttggtgggactgtaaactagttcaaccattgtggaagtcagtgtggcaattcctcagggatctagaactagaaatgccatttgacccagccatcccattactgagcatatacccaaaggactataaatcatgctgctataacgacacatgcacacgtatgtttattgaggcactattctcaatagcaaagacttggaaccaacccaaatgtccaacaatgatagactggattaagaaactgtggcacgtatacaccatggaatactatgcagccataaaaaatggggagttcatgtccttttagggacacggatgaagctggaaaccatcatcctcagcaaactattgcaaggacgaaaaaccaaacaccgcatgttctcactcataagtgggaatcgaacaatgagaacacatgaacacaggaaggggaacatcacacaccggggcctgttgtggggtggggggagggggagggatagcattaggagatatacctaatgttaaatgacgaattactgggtgcagcacaccaacatggcacatgtatacatatgtaactaacctgcacgttatgcacatgtaccctaaaacttaaagtataataaaaaaaattatccaccaggcgtggtggctcatgcctgtaatcccagcactttgggaggctaaggcaggcggatcatgaggtcaggagtttgagaccagcctgtccaatatgatgaaaccccgtctcttctaaaaatacaaaaattagttgggcatcatggcaattgcctgtaattccagctattcaggagcctgagtcaggagaatcacttgaacccaggaggcagagattgtagtgaactgagattgtgccactgcactccagcctgggtgacagaatgacactctgtctcaaaaaaaaattgttaaattttcgtaacaacctattgaaataaggcagcaaaatcctcactttgtagaagaagacattgagcctatgagaagtaggttctccaagaacaaatagctgttcattatggagctaggccttatgcagagttgggacactttctattatgtcaagctaaggcaagttaatttactgagtcacagtgccctcgatttatgagtatttcacctttttttctctttaattagaagcttattgagaagcttgtggaatgtaggcgtaagtgtattggataattaaagttttgatattctgatattgttggaactacttgaagaatttaacatttggtaagtatttttcatatgagtattaaaatagtaattttacttattatatgtttatacatagaatttgtcaattactttctgactacaaagacaaacagatacaaaaaagccgttctctcaacagcaatccaagtaagacttctgacagtgaattactctaggtcagtggttcccactctttttggcaccagggaccggttttgtggacgacaatttttccatggactggaggaaggaggggatggtcttgggatgattccagcacattacatttattgtgctactttatattattatattgtaatatataatgaaataatgatacaactctccataatgtagagttagtgagatccctgaacttgttttcctgtcactggatgttctcatctggaggcaatgggagaaagtgacagatcatcaggcattggattctcataagaagcacacaacctagatccctagcatgtacagtttatagcagggttcatgctccaatgagtatctaattctacctctgatctgacaggaggtggagctcaagtgggaataggagaaatggggtgtggctgtatatacagataaagctttgctggcttacctgccactcacctcttgctgtgtggcctggttcctaacaggccatgggctggtaccagtttgttgcccaggagttgtggacccctgcgctaggtggtcctaccatagataagaaagtaaaagtaaggaagtttttatcacaaaaaaaaaacagtttgaaaaatcactgtgtataaattgcatgtatatattttacaattttttttgagagtaggttcgatttcagaattatttaaaaatttcattttaggtgatttataatttcaaatatctgaaaaatttaattatggtctctaaaatcttgtataatatttttatgtaaataagaaaaacacaagttagtacatggtatatcttttttacggtcacatgataacaaattggacttgttatacaattgaatcttctatttaattatttaaataaatggtttgctttgagcaaatgaatgttaattacagttgacccttgaacagtgtaggacttaggggtaccaatcctccatgcagccaaaaatctatgtataacttttgacttccctcataacttaactactaatagcctactgttgaccagaagccttattggtaacacagtcagttaagatgatatttggtgtgttataagtattgtatgttgtatttgtacaataaactggagaaaagaaactgtcgggaagaaaaaatataattaatatcaagtggaagtggatcatcataaatgtcttcatccttaatcttcaagttgaataggctgaagaggagaaagagggaggttgggcttgctgtctgaggtgacagaggtagaagaaaatctgcatatgagtagtagacccctacagttcaagcctgtgttggtcaaaggttagctatattacactgaggtttgtgtcactaaaaaagtaactatctttaaaagtggaaactcagcaatacctttctaataccataagcaaatgagaatgagaactgcaagacttagtcagtgtgcagcaacaccaatgagaaattattttttttaaagatacctacagaagtgtccctgtctgacagctttgaagagagcagtggttttcccagcatgcagctggagatctgagaatgggcagactgcctcctcaagtgggtacctgacccctgacccctgagcagcctaactgggaggcaccccccagcaggggcagactgacatctcacacatctggccaggtactccaacagacctgcagctgagggtcttgtgtgttagaaggaaaactaacgaacagaaaggacatccacaccaaaaacccatctgtacatcaccatcatcaaagaccaaaagtagataaaaccacaaagatggggaaaaaacagagcagaaaaactggaaactctaaaaagcagagtgcctctccacctccaaaggaacgcagttcctcaccagcaatggaacaaatctggacggagaatgactttgacgagctgagagaagaaagcttcagatgatcaaattactccaagctacgggaggacattcaaatcaaaggcaaagaagctgaaaactttgaaaaaaatttaggagaatgtataactagaataaccaatacagagaagtgcttaaaggagctgatggagctgaaaaccaaggctcgagaactacctgaagaatgcagaagcctcaggagccaatgcaatcaactggaagaaagggtatcagcgatggaagatgaaatgaatgaaatgaagtgagaagggaagtttagagaaaaaaacaataaaaagaaacgagcaaagcctccaagaaatatgggactatgtcaaaagaccaaatctacatctgattggtgtacctgaaagtgacggagagaatggaaccaagttggaaaacactctgaagaatattatccaggagaacttccccaatctagcaaggcaggccaacattcacattcaggaaatacggagaatgccgcaaagatactccttgagaagagcaactccaagacacataattgtcagattcaccaaagttgaaatgaaggaaaaaatgttaaaggcagccaaggagataggtcgggttacccacaaagggaagcccatcagactaacagcggatctctcagcagaaattctacaagccagaagagagtgggggccaatattcaacattcttaaagaaaagaattttcaatccagaatttcatatccagccaaactaatcttcataagtgaaggagaaataaaatactttacagacaagcaaatgctgagagatttcgtcaccaccaggcctgtcctaaaagtgctcttgaaggaagcactaaacatggaaaggaacaaccggtaccagccactgcaaaatcatgccaaaatgtaaagaccatcgatgctaggaagaaactgcatgaactaatgagcaaaataaccagctaacatcataatggcaggatcaaattcacacataacaatattaactttaaatgtaaatggactaaatgctccaattaaaagacacagactggcaaattggataaggagtcaagacccatcagtgtgctgtattcaggaaacccatctcacgtgcagagacacatataggctcaaaataaaaggatggaggaagatctatcaagcaaatggaaaacaaaaaaaggcaggggttgcaatcctagtctctgataaaacagacattaaaccaacaatgatcaaaagagacaaagaaggccattacataatggtaaagggatcaattcaacaagaagagctaactatcctaaatatatatgcacccaatactggagcaccccaattcataaagcaagttctgagtgacctacaaagagacttacactcccacacattaataatgggagactttaacaccccactgtcaacattagacagatcattgagacagaaagtcaataaggatacccaggaattgaactcagctctgcacccagtggacctaatagacatctacagaactctccaccccaaatcaacagagtatacattttttcagcaccacaccacacctattccaaaattgaccacatacttggaagtaaaactctcctcagcaaatgtaaaagaacagaaattataacaaactgtctctcagaccacagtgcaatcaaactagaactcaggattaagaatctcattcaaaaacgctcaactacatggaaactgaacaacctgctcctgaatgactactgggtacataacgaaataaaggcagaaataaagatgttctttgaaaccaacgagaacaaagacacaacataccagaatctctgggacgcactcaaagcagtgtgtagagggaaatttatagcactaaatgcccacaagggaaagcaggaaagattgaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaagactaataagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacagacactctcccaagactaaagcaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggtggaggcacaaccaaaaaaagaattttagaccaatatccttgatgaacattgatgcaaaaatcctcaataaaatactggcaaaccaaatccagcagcacatcaaaaagcttatccaccatgatcaagtgggcttcatcctgggatgcaaggctggttcaatatacacaaatgaataaatgtaatccagcatataaacagaaccaaagacaaaaaccacatgattatctcaatagatgcagaaaaggccttagacaaaattcaacaaccttcatgataagaactgtcaataaattgggtattgatgggacgtatctcaaaataataagagctatctatgacaaacccacagccaatatcatactcaataaattaggtagtgatgggacgtatttcaaaataataagagctgtctatgacaaacccacagccgatatcatactgaatgggcaaaaactggaagcattccctttgaaaactggcacaagacagggatgccctctctcaccactcctattcaacatagtgttggaagttctggccagggcaattaggcaggagaaggaaataacgggtattcaattaggaaaagaggaagtcaaattgtccctgtttacagttgacatgattgtatatctagaaaaccccattgtctcagctcaaaatctccttaagctgataagcaacttcagcaaagtctcaggatacaaaatcaatgtacaaaaatcacaagcattcttatacaccaacaacagacagacagagagccaaatcatgagtgaactcccattcataattgcttcaaagaaaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccacatcaccaagtcaatccaaagccaaaagaacaaagctggaggcatcacactacctgacttcaaactatactacaaggctacagtaaccaaaacagagatatagaccaatggaacagaacagagccctcagaaagaatgccgcatatctacaactatctgatctttgacaaacctgagaaaaacaagcaatggggaaatgattccctatttaataaatggtgctgggaaaactggctagccatatggagaaagctgaaactggatcccttccttacaccttatacaaaaatcaattcaagatggattaaagacttaaacgttagacctaaaaccataaataccctagaagaaagcctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtggacaggaaacctacaaaatgggagaaaattttcacaatctactcctctgacaaagggctaatatccagaatctacaatgaactccaacaaatttacaagaaagaaacaaagaaccccatcaaaaagtgggtaaaggatatgaacagacacttctcaaaagaagacatttatgcagccaacagacacatgaaaaaatgctcatcgttactgtccatcagagaaatacaaatcaaaaccacaatgtgatatcatctcacaccagttagaatggcaatcattaaaaagtcaggaaacaacaggtgctggagaggatgtggagaaataggaacacttttaccctgttggtgggactgtaaactagttcaacctttgtggaagacaatgtggcaattcctcagggatctagaactagaaataccatttgacccagccatcccattactgggtatatacccaaaggaatatgaatcatgctgctataaagacacatacactcatatgtttattgcagcactattcacaatagcaaagacctggaaccaacccaaatgtccaatgatagactggattaagaaaatgtggcacatatataccatggaatactatgcagccataaaaaatgatgagttcatgtcctttgtagggacatggatgaaattcgaaatcatcattctcagcaaactttctcaagaacaaaaaaccaaacaccgcatattctcactcataggtgggaattgaacaatgagaacacatggacacaggaaggggaacatcacactctggggactgttgtggggtgggggaaggggggagggatagcattgggagatatacctaatgctagatgatgagttaatgggtgcagcacaccagtatggcacatgtatacatatgtaactaacctgcacattgtgcacatgtaccctaaaacttaaagtataataataataaaaaaaaccagctaaaggaaaagaaatattttgagaacactgaaaatatgaaaaaaagaatgataatcttctaaaagctataaaattgaatgaggaaactttaacaaaagaggtatttcactacaatgaacagcttagcattttgacaactgagaataaaatgcttggttttaaactgggggatataaagcaccacaaggaaagactggaaacagaaattcaatcatataattgtagactggccactgctgtatatttttgtgaccaaagtgagaaagcaaaaagagacctctttccagagaataagacacaaataggttcatttacaggagaaaatgaagtttgatatgcctaccctaaaaggtaacagtgaggttctttctgaacaactctctaatgctgacagtaaaattaacagcctaaaaattaagctccatcacacaagataaacactcggagaaaagacttcagttttagaacatttccaaagagatctatgccaaacacagacagtgtcaaaagaaagaaattgaacaaatgtgtcaaaatgaacaaagcagagtaaataaatatactggagtgcagaaacctatgaagacagattttctcaactacaaagtgaaaataatttgctttggcagcaactggatgatgctgacaagaaagctgagagtcaagaaaagacaatcagtactatccaagagcaattccatgctgttgtcagaaatcttctagctgagagtataaagtcttctgctggaagaggaaaacgaggagataatcaatgtacgtaatcccttgaaagaaagaatatatcaatgtgaaaaagagacagtgggaaaaaagtaagtattaacaaagatatttttcaaacttcctgaaagaaaatttaaagtaatatttggttatggtaaatgttatatgtatttgaatataaaaatatgtagaccataaaatatatttgctgtacggcctagaaacataccagcaaaaaaaggtagacctgaaatttgccttattttgaacaacgaaattgtatcacctttgaaattttaagactttattttacaaatttactatatatagactaatagttctaatgtggacttctgctgaaataattttaatatctctctgtggactaattttaagaccatgatgagacagataaacagaaatgccttttacctgaaatgaattttttgaaattaagattcaatcatgtgggttactttgacagttatttccagatttcccaggtgaactgaaatatactgctgtatctcatagtacttttttaaggtagctttttatgtatttatgttggtgtagttttatttttatttttactgatttgacttaaatctgagactttaagtctcacattattgttatgacctctcaattatttgaaggcatttactttttataaaatcattatttggaacagatgtgaatttccagcaaaaccatatttgatttagtcgtacctctggtgtttataattttaatgttcttaaaagtaatttgctcatgatttttatcttatggctcaatgactgtcatttggctataaccttgtccagtacaaagataattgtgtttgtctgcagttgctttgtttagcattgggttttcattttaaagctaatgagggatggcagaattcacatacagttggaatggaatgagtaggggagagagttataggaactgaggtaagggagggaggtggaggccaggttacctagggcctccaaatgtcattggaattttacttttattctgaggtagaaatctattagaaggatctgagcaggcaattgaatatgtgaggagtggggaggtttatttgaggttctgataaaaaagaggaaagacattttacactccagcattttccaccactagtgccacccacataccgaatttttgggacttcagtaggttgttaagcattgtaaatgtatcaggggttaatgaatagtgggctgattctgtcatctagcagaatactcatttggaaggaatataacacctgtgtccttaactgaattcagtaataagaatgtatacacatgaggaaaagaaggtgaatccatgtatgtggtgctatttttcaaagtatatgttgaatgttatgatcatgttttaataataaggtgatatatgaaatcagtaacaaaaatatcttaacaggtaattatgagacaacttctacaagaaccggctgataccctgaaaaaaaacctgtcagagccttccctagaggctacaccacattgtcacattaatttagaagagacacaagattcaaagaaggaattaggtaaaatcagagtcaagtatgtatgaaatgtaacatgtcaacagttaatctgtaggtggtggaggaatatatagttttaggatgctaattgcagtggatagatttcttttgtattttcattacaattaattttattatctttatcatgcacttatttcttctgacttttcagtctgtcatgtttttctcataagtatgtacattttaaagataatatttacccttaagaaagctgggaattatacatcattcctcacagaagttgagagacttttttttgtgtgtgaaacagtatttttcagggatttctctgttgccatgttgaggcaagccagattacatcagaggataatgttcaatagaatgttccagaaaagcatcttattgcttatcttactttcttggatgggtgcagaatctttgtatatttattgcatgaattttaggataacttgtacagaaaggccattatacttttctccaaaatgcagatgttttaggttaatttacaaagtacttgaaatgttaagcattcccttcttttttctttcattttaagtatattgtaaaagcatggaaatgctcagtttgtgtagagtatatacatccaaattagaggattaagaaacgtatctagatcctaccattgggattttaaaagacaattgtagtgatgtataatttgaacaccatacagttcacatggtctcttagtatattcacagagttgtatagccatcaccatcaccaattttagaatattttcatgatcctaaaaagaaacagtgcatcattttgctattatccaccagtttgcccttcctcagctctagggaaccaccagcctactttgtctttatagagttgcctattctggacatttcatatcagttgaaccacacaatatgtggtggtcttttgtgattgggttctttcacataggataaggttttaaggctcatctgtgttgtaacatatatcagtactcaattccctcttattgctgagtaatattccactgtgtggatatatcagtcattttatttactcattcctcagttgtggacctttgaattgtttccattctttggctattaatcatgtctgcttttatgtacaagtttttgtgttttcatttctcttgggtgtatgcatacaagtggaattgctgggtcatattgtaactctatatgtaacattttgaggagctgccagtctgttttccagagtggctgtatcattttacattcctatcagaattgtgtaagggttccaacttctctatttctttgccaacatttttcacatttttgattaagaaaagatttcctcttagtggtgtgaaatgatacctcattctggttcgatttgcatttccataattccctatgatacctcattttggttcgatttgcatttccctaatgactaattactttaatcatctttttacgtgcttcggagtgacttgtgtatcttctttggagaaatgtctattaaaatgcagcctatttttaaaagtggttgcctttttgtttgtgaatccataagatccttaacagatatgattctcaagtattttctttcactcaataggcttttttaaaactttcttgatgatgtctgttcacgtgcagacatttcaaattttgatagtcattaatctttttttgcagtcacaaagatttatgtctatgctttcttctaaaaattttatagttttagctcttatatttagtgattctattttgagttaattttagatacagcatatgccaggagtctatttttattcttttgcatgtagatacctagttttcccagcaccatttgtggaaaagactattcttttaaataaattaatattcttttttaagtgttgttctttttggcacccttgttgaaaatcaattgaccataaatgtgagtttatttttggattctcaattctaatatgttgatttatgtctactgttatgccattaccaaagcaaattttagaattgttttccaatcgtgttacttattattaccaattgcctaaagtaagaatagaaattcaagtactaggtagcctttaacttcactgtttgcttcttgaaggaacatgtggtcagcttatattatggtaacttcatgcttaaccttttgaggagctgccagtttgttttccaaagtggctgcaccactttacatttccagcagcattgtataagggctttaatttctttacatttttgctaatatttatattttcctaatgactaattacattaagcatcgattaatgtgcttatatccatcttttcttctttgcaaaatttctattcaaaatctttgcccatttttaattgggtcatctttttatttatgaattgaaagggttctttatatatcctagatataagtcccttatcagatatatgctttccaaatattttcttctactcgttgacttgacttttcactttcttgactgttttctcacacacagaatttttcagttttgaagtccattgaatccatttttcctttggagtcagagctaagaaaacactgccaaatgtagttacaaagacttatgccaatgttttcttctgaaagttttagagttttagctgttacagttagctgttttattttgagttaattattaaatatggtatttagtgagagtccaactttattatgtttttgcatatggatacccagttgtcccagcaccatttgtctaaaagactattcttttcccatttcattgttttgttaaccctgtaaaaaatcaattgactgaatacgcaggtttattttttaatgatcagttctttgtttatgtctattcttatgccagggccaaattgaatttaataagtttttttcaatcatgttgcatattaccagttgtcttatgtcataataaatattaaatatagtggaacatctttaacttcaccttctgcatctccagagagtctgtggtcagcttatactttacttatcctaagacatgatgagaagtcaggcttacaagacacaattcatttctttttttttcctccattcaagcctttagtgtcttatccagtgcctccctctatagtttcattttcagtaaattttggtcgcaggatccgctgacatagcctactatttagtgcattatgtcttattaactcattataattcatagaatcatccatagatgcttaccatctagaaaggagaagtttaagtctgagctgccagctttcctcagtggaagtcaagtgaagttatcatctttcaattcgcagatcctttttccacctggtagctggttctcttgtgtagcactgtggctgatccttttcttggtgcagatcctgcattctcagaaaccacagttccctgtattgacctcgttttactgaaacagagatgcacagctgtgctttgtagcttagtagaagattcttggagtaaaaagtttaactcattgcaagaaaaatatttaggagtgcagcgcttaaaaatctggtaatgttcaggaaatttatcagtagtagattagtaatttgaattttaaaatttcagagtcaacttgtgtgctatagagaagcgttgtggtataacatagagatgggatggtcttaacttctccatacaaacaagcttgaagtaaggatgaaggagaaatcgcatttgatttcttaacactcaaggcacactacatttattttacttctgtgaagattaaaaataattccatcgtgttctccttgtttccccactgagtaaaggaaaatgaaaatggaatactagattgattaataaatactcaaagctgcttacttttagaatttttagttaattgaaatcaggtaaactgtctgattttggttatttaaccaagtagttctagttgtttttaaaaatcacgtcttcttgctttccagtcttatttcctaacttgaggggaaattctaaggagacacccttgccttgtcatcagagttcataattgaagggagttttaggaaaagttcatcctcaggaacttatgtctctctcccagttatctgctgcttctcaataatgcttgtcatcaataaattaatctcaacatttatttgattctactttaaaagagactcttttctgctgtgtaagttatgtttcctgttgtctcttttttaaaatcatttttttctaacaattacccagagtttagtggcgtaaaagagaaacatttaaggctgggcacggtggctcatgcttgtaatcccagcactttgtgaggcagaggtgggtggatcatgaggtcaggagttcaagaccagcctggccaagatggtgaaaccccgtctctaataaaaatactaaaaaaagaacaacatttattttgctcatgaatctgtggcttggaaaaagcttggccaggacagcttgtctctgcttccctcagcttccctaggaacagctgaatgactggggaaatggaatcatcagatgctttgttcaaccatgtgtttgatggttaatgctggccattggctggaaccttggtttgggcaggcagcatgaacactgacactggcactcccaggctctctttgtggcctgagctctctcttagtctgggggctgggtttgaagggaaagcagttggagatagagaagccacatggaatcccttattactgcattcttttcattagaaggaagtcagtaaggttggcccgtattctatttttttagtgggatgaatttatcttctcttttgtttttaattgacatgtatatacaaaattatgagttataaagttatattttgatacatgtatatagtgtgtattgatcaaggtattactagcatatttattacctcaatcatttttcaaaaagtcttccagctttttgaaaatatacaataaatcatagttaagcatattcaccctacaatgctacaggacgccagaactcattccttttttataactgtaattctgtatctattaaccagcctcccctcccttacttccttgagttttttgttgttgttaagagacagggtcttgctagtctagtctgggccctgggcaactgcagtcactcagactagagacaatgatttgatcatagctcactgcagcctcaaactcttgggctcatatgatcaccccaccttagcctcctgagcagccaggattacgggtgtgcaccactgcacctgtctgattttttactttgtagacatgaggtctcatgatgttgcccaggctggtctggaacttttggcctcaagcagttctcctgccttggtcttttaaagtgctaggaaattgcaggcatgagccatgttgtccagccttcaatttttctttagctcccacacatgagtgagaatgtgcagtatttttctttctgtgcctgcacttaacattctccagactcatccacgtggcaacaaataacaagatttcattcctctatatgtggaatactattccattttgtatgtatactacattttttgtccatttgttgatggacatataggttgattccatacattagctgttgtaaatagtgctacaataaatgtacgagtacagttatccttttgatcttttgttttcgattggctgaatactcagtagtgggtttgctggatccctcagcagttccaatactagttttttgagaaatcctcatgttgttttctgtagtggctgcactaatttaccttcctatcaccagcatataagagtttactgttctctgaaaccttacctgcatttgttattttttgtcttttcaatgatagtcatttatttgaactggagtgagattatacctcgttgtaggtttgatttgtgtttccctgatgattagtgatactgagcatttttaaatgtatttatttgccatgtgtatttctttttttgaaaaagaaatgtgtattcagatcttttgccttattttgaattcagattttttttaatgtcaagtgtttgcgttcttgtatattttggatattagtcctttattagatgaatagtttgaaagtattttctcccattctacaggttttctgtttactcagttgttttctgggcaaaagctctttagcttaatgtggtaccatttgtctatcatttgttttttgcctatgcttctgatgtcttatccataaaaatctttgtgcagactaatgtcctgaagcatttttcctatatttactgctagtagtttgataattttgggcctgacatttaagtcttcaattcattctgagtttattttggtattggtgttagataggaatctattatcattgttctccatatgtatattcagttttcccagtggcattcatttgaagagggtgtcctttccccaatgtatgttcttggcatcttagtccaaaatcagctggctgtaaatatgtggatttatttctgggtggcatgtgccatagactttaccccaagaatcattacttcttaaaatgcaattcaaattagcataaaacatttgcattttagggaaaggcttatgacattagaatccttatttacaggattcattattttgtctcttttttttgagatatggtctttgtctgttatccaggcagaagtgcagtggtgtggtcataattcactgcagccctgaactctgtgtccaagccacccttttgcctcattctcccaatgagctggatgtacaaggcatgaataattaaaaataatttttttttgtagagatgtggagtctcactgtgtttctgtggctgctctcaaattcctggcctcaagtgatctttctgccacagactcctaaactgctaggattacaggcatgagccaccatgcctagcatagagtgttatattattttcagtgtcttattctgagagccattttttgactttggcctaaatatcttaatatgatatctctgaaactttttttgacaaattatggggaatgatgatgagggaagaggtttataaactttctcctaagagataacttagagccatttaaggaggaacaaaaagaaacaatcagaataataaaagatcaagtgcaaaatttctgcatcaaagatgatgatagtaaagaatatatttttgtgactcatggtggtctaattttgttcttgaatttctgagtaatttaagggttaacatttgaggaatctgctacattacaggtaatattttattccaagtaaatgtatttcaaaaattttattggtttattattaaaccaaaatttttattggttttattattctcagctactgcattatcaagctgtattatttcattcatgcagtttgatgatctcacagcagaattggaagctgtatctttacaatgtgtctatttggctgaaaacaatcaagttactcaacaggagttatctatgaaaaaagtacaacaggaatgtgaaaaacttgaggaaaataaaaagatgttggaagaaggaatagtaaatcttatgacacatatggaaaaatatggtagaacttggtaaagtacaagaatataaattggagctagaagaaaaagcaatgccagcaatagaaaaaaaatagaagaaatccattaacacgttagtttttaaagtcaggtaagtttatctgtaatgtgctttcatttatttcactgcaaattacattttagatattatatgtattgtgtttactctgcctctcatagcaatttgtagagttctagaaacaggtggcatctgtgtttttcttttaaatatttaaatttccatcattattataacaaaattgatctttcagagtaatgattctcactatagactcacttgattgttaagacctgtaggcataagactattaggaaaagagaagattgtgatttagaaattaaatgatacttttgaattggtcttaagctacattgttcattgttcagtttttaaaattataaatggattctattactttttaaatgaccagattgcattaatactaacactactaaacatacactcatagaaaatggaataagcttattaatttgttttgaaagcataatctagtgagatgccttcaggagattagtagaaagtgaatgctaacttgacaatataattttggaaaataatgtcagtaaataatcttacctttaaaacgttagtcagggagaggttcggtgtctccttcctctctctctctctctctcttttgtatggcttttttttcctgaaaaaatctcatgtagttaacttgatctattagtttttttcactaagtatttttgaatcgttataattaataaagtgatcttgttataaaattacttgtcagaattaccctaagtagaaatattaatgagtttaatttactttttggtacatcacaacctaaacccaaagtgtcaagtactactgctgctctgggtatatcctggccctcaggcatggaactgtccttgattgtgatctttagtattatcactatagggcaccttaagaaagactattctgtgtaacattttcaaactacagaaaggcgttcttgtgaaatagggaataattattacaggaatgaaaggaagtgtgattcactaagtggtttcaaaataacaccttgttcagcctgaaggggtgtgtggaagacagaaagaaaaaaccccatctccagtgccttggtcacaatgttaggggctaattgtcttcagagatgctttagttctttttgatcaccaaccaagccatctacttctctactatgagttgttgctcagaattattcatcattgccaaatgcttaattgttcctagataatgggtgaaatgtacaagggtgaaacctgaaactggtttactaagcacaagtatttctagcggtttttttttttggttcattttagatttcttaaatgtatattatttaaggagtacaacaagccgttttgatataactatttatagtgaattggttcttatagtcaaacaacttaacatattcattttgtcacatagttaccctttaaatacaagtatttctaatagaatcttccaaatcttacaagtagagtcattttagaaagcagcaagtgttacctgttcagccccacattactgatagccatttctcttccctctctactttgtttgaattgcttattcagtagaaatcaccctagaaacacatgtacttcttttgaacgactttaaaattataattggttacaacagatatgctctcacacatcttcggtgagaaaacactttagtgggtaatttggtttactctctcagcaacttttaaaaaagtggaagtcattaagactcacttaaggaaaaatgaaatactaagcatttgtctttgctatcttcacagatcaaataagaaaacaagtgatcagcaccaagctccatatggagaaagagtggatgaaagcttttctcagtgctctttctatgaggccaggctcagagccaccttgtgttgaaaatcttaatagtataggactcaacagaaaatgtattcccaaaacacctgtaagaattcctacttcaagcccacagacttcaaattaccttttctattttgggttttatttcactaataatattcttgtttttaatttggtgaaatactgagttgttcagttgacctatgcatgttaagtaaagattatagttagccatattaacacagaaaggaaatgggaactttacttttttttaaattccccagagctctaattttcaagagacacccatttgctaactttattcagtaaatgtaaataaactgacacatttcaactttctttaaaggctgcacttaagttagattttagaaattgcatgttattgcctaataactgaaggtatattttgagatgctttggcttacgctctaattgattgtagtttggctgtggttcatgccacttttaaggtttctttgtaccatctcaactcttcccacccatactcacaaaggaatgattggcatccaaacacttaatcacacatgggtatttactatttaatagaatccaaaataagtgcattttatgaattaaataaacataaaatactaaaagattcatttccatttttattttaaaagccttgtgctcttcttacataagagtacatcctctgactataaaaatcctggaagtaaacctaggaaatattcttctggccatagtggttggcaatgaatatatggctaagtcctgaaaagcaattgcaaggataacaaaaattgacaagtgtgatcaaattaaactaaagagcttctacacagcaaaagaaactatcaagggattgaacagacagcctacagaatggaagaaaatattcacaaactatgcatacagcaaaggcctattatccagaatccataagggacctaaacaaatatacaaacaaaaaataactccattaaaaaatgagcaaaggacatgaacagacacttttcaaaagaacacatataagtagccaacaaacatattaacaattgcttatcactaatcatcagagaaatgcaaaacaaaacaacaagataccatctcacaccaatcagaatgaatattgttaaaaagtaaaaaaaaactggtgttgggaggattggagaaaagggaacaattacacactgttggtggcaataaaaaattagttcagctgctatggagagcagtttggaaattaagaactaagaatgatcattggatgcagcaaccccatttctatgctgggggtatacctaaaggaaaagaaatcatcgtaacaaaaagatgcatgcacatgtatgttccttgcagtactattcacaatagcaaagacatggagtcaaccaaggtgcatccaaggtagactgaaaatccaaagtagattggaaaatttcacatacaccatggattactatgcagccatagaaacaacaaaatcatgtccaacatggatacaactggaatccattatcctaagcaaactatcatagaaacagaaaaccaaatatctcatgttcttactcataatgtgggagataggcattgggttcacactgtcataaacatgggaatagtagacactgggaaataagaacggggagggacagagtaggccagggttgaaaaactacttattggatcctatgctcactacatgggtgacgggttcagttggaccccaaacctcagcattcctcaatatacctttggaagaaacctacacaggtaccaccttgatttagaatacaatctagaaaaaatttactataaaaaaggttactgtaagtggagaatagaaatttctttttaaggaaaagtttactgaagtaaaaaatggattgaacttttataaagggcagaattttgctaagagttttgaagcaatgtattcattgcaaaacatgactttaattgtttaacctttgtactaataaaacaccacctttttaaaattatttatatacaatagaccaatattaattttattgttatcagataaatctaaacagcattacacagatatatcctctattatctaaacttaaaataagtagaaattttattttatttatgtgattatttttctatttaaacaagtgttcaagttatgtgtagtcactaaatatactaaaggccacattttgtaagtgatatattattctcacgataatgtctcttgtttaacttaaacattattattatttttacttgagatggagttggactgtgtagaacaaataattagagaaacaaagaaaagtatgttgccaaaatttattaattaaatttagacttattttagaaataaactgtatatagcaaatggcattccttttcattgttgggttagtagatactatgttattcttttcttacatacatctaatgacagatgtgaaaacaaaaactttcacaatgaagagtatacttatgcaccattaattcatcatgttccatagcttaaaaaattcccaagaagtctatgcatcccttttttactggctctacactttattcacttttgtcattctcatggaactgtcagccagcacactcaaacaattctcagcaaacaaaggcatcatcaggttctcagggttccggtagagacttaagaccaacagacctcatgctcatttagaaatactcagctgagccataaccattcataagcagtcacttgacaggtgacattttaaattttctgtcatttactttgtcattggcttacttttgttctcaggaaaagttctaaatttttcaccatggaataaaaacacctacatcaatgtgattcttgtcaagttactcagccttgtctctagccacttaccacactctgccctttgctctagcaccaaactggatggagtggaactccacagggttcttcctcacctcaggctctttgccttcatctcttccctctatctggcaatcttttcctcgtccttcaggcatcaacctacctatcttctccaccagaaagcctatgatattgacacaaaactgggatagatgactcttctgtgtgttccagtagtaccctgctatatacctgtcatggcatctatgactctatgtggacattgcctgcctgtctgttttttcagattacagcatatgattgttgagaggtggaccatactatcttcatcttgtaattccagtgctggttctagtaccttagcacatggctgttgagtatgtgaatgaagaataaaaagctctcatatttaaccacaattgtaattaattccatgtgtaaatacgagcaaattctatttaatagtaattttgtattataattgtacatacatatttctcattcttattaaccctgataaagttctgaactctttatttatttatttatttattttgagatggagttttgctctttttgtctaggctagagtgcaatggtatgatctcagttcaccgcaacctcctcctcccaggttcaaatgattctcctgcctaagccctacgagtagctgggattacaggaatgtgccaccatgcctggctaattttgtatttttagtagagatggggtttctgcatgttggtcagactggtttcgaactcctaacctcaggtgatctgcccacctcagcctccccaagtgtggggattacaggtgtgagtgactgcacctggccaactctttagtttttaaacttacacatagttaactgaaatgttttaggtaaagaacataattctttatttttctttccagcttttgctgtgttggacattttctcccatctggtttcttctttagaatccactgatgagcaacaactaatgaagagaatatctaaaccataaaatcttaaggaaaaagtttatgatttaaaagacctaaaacatcttaaaactttattactgatctgtgtacatgacattttaattgtttctcataaaatatgtaacatcatgatcttcactaaagtagaatatgtttgtatcatatgtgtgatgaaaatgtatatggtattttaaatgattttttagcctctttaagttttaagttgatcttgtaaatgaaaaccagtattgttgagtttgacatactcaaattgcccagatttcagctgtttaaacagccaaacaatcaagtcatcattgatacttcagtagaggtcattgatggcttattggcattttatagcttttactactatatataataggagacttgaggagtaccagcctggtatgttcgtgctaatgttactatttcctttttttctttttttgagatgaagttttgctcttgtcacccaggctggagtgtaatggcgtgatctcggtcactgcaacctctgcctcctgagttcaagtgactctcctgccttagcctcccgagtagctgaggttacaagcacctgccaccacacccagctaattttttttttttatttttagtagagacggggtttcatcatattggccaggctggtgtcgaactgacttcatgtgatccacccacctcagcctcccagagtgttactatttcctttttgtagttcaacagtattttgtgtggagatattttgaggctctgtaaatatctggttgctcctcaaaacccactagatttagcatttcatggatgacttgtgtttgagcaattattaccgtaatgattgccaaatgattactttcttattctctcctttgttctacatggagaaataaaaccaatacataaccgagaagggaaagctcgtgattctggtcctcaaatgccccaagattaggccagtggtagacatttcaagctcccttcatctcttttttatttgtccccattagtctgtcagcacttttttactttctggcacaagatgctccaagcttatcttgtattttctctgccccagccctggaatgagtgattgttcttagaagcagaggtggagccaccgaggaagcacaggatgagcattccgcagcttgcacttactggtccccagtaggaagaaccactgctgcatccactgaggtaccaagaaagtagcaaagaaccttctgactgtctggggacagtcctcatgtggtccttggctcagcctgaaaggttctggattagtctccttgaagcccctgtgatttgtctctagacctgtgctctgcaggaagggccctgagagaccaagcagcacagggtgtctcatctgccaaatgtccctcccttcctcccactctgagactcaggaataggctagatgatgtgttcaggcagtgccaggccacctcactgtctcctttgagatgggcccagaggaccttggggggtgagtgagaagctgggcacatggagcctgaggctgactgtccctccctgtgtcttggaggaaaggccttgtcccaagaagacccacagggcctgatctgtgggcacacatgcagggagggatggtctgtgggctgactgggacattggaatgagactttgagcactgctgctcaggggcctggtcagtggcccatggtcagtgatgacctggtcatcaggacctggccagttggggcaggatcagggacctcgttagtggtggcctcctcagtgaaggcctcatcaatggggacctgaagacctagtcattggaagactggttagtggtgacctggtcagtggtggccttattagtggggcctggtcagttggaacataaacaaggaaaaagtagttggtgggatctgtatacttggggtctggtcagttggggccttaatgggctgggacctggtcagtgggagcctagtcaggggggcctagccagctagggactaattcatggagaattgtttagtgggattcgggtgagcagcaaccaggtaaattgtggtcttctcagtgggggcctggtcagaggaaaattggtcagtggagtctggtccatggggcctattaatgggggcctagttcgggagagatggccagtgggtacttggtcaatggggacctggtaaatggaagagtggacattaggaacctggctagtgggaacctggccagctggccgctgtgtgacctcaggcagggggtttgtctgaggaacctccttgcctccacctgtagggtaggtgagtcaggtcaccctggagggctactgggaagaggatctgagaagttgtattgaatccagcattgctgggcagacctagcactttacacacgacctagattccacctagggagggtgccagccctctgctgtacccagtgcccctcctctgcatccccatgaccaccctgggtggggaggacagagattggggagctcctgtggagacactaatgctggccccaggccctggtggtgacagtgatgaggacctgggtgcacctgtgagtggagcacctaggcctagccatagaagcaacacaaacacacacatgcacacaaaaacacacacacacatgcacaaacacgttgcacacacacatctcagttcaggggataagggatactgactctgtgccctgtttatccaagcaggctcccattgtgatgggttatgttgccccacgatgtcatcattgctgagcccccagtgcctctgtgttgtggagcagttagagacacatggcagtgtccttgagtggctctgagtgtgggaccattttctaggtgatcactcagcatagcttaccgatcagactcaagtgaatggaacctgccctcttcccttcctcctggctttggaacagttgctaccaggtgagtggtttttccctccagacagttactgagagtaatccctgagcactcactgggtgcctgttctgtgctgacagtcatctcattcatcctaacagcaattccattctgcatcttctctggacacccccaggaccatccaggacaaccctgcctgacaccaggcctagtgtggctccatgataacaaagacgcaggtccagagacaatccccctacatggtgcctgcatctgattccccttggtgggtagtgacgatcacaacatggaagaagccagggcagcttgcagccagctgctgtgcagccccagatggctcctggaccttgggaagtaattctcaaaggggaagctggtcactttgaggtccctggagggatgggtgaatgtggcatactggcaacgctgacagccagcagcatgccatacatctcacctaacatgtgggacagaggccccctccaagagcacgagtctcatacatgaagcatcctgtctcaggcctcatcctgagccctaggaggggaggggtaccgtgggccaccagcagcagccaggattaccacacacgggactcagtattctgtagccctggccagacttagaatttggcccaagacaggacaatatcactcggagcagcatgtcggtacttggggtctgtgcatgccaggcaagaccaacctggctcaaagagcaatcagccacctctataagggtgtcccaggagcaggtggaccagccaccaacctcacccactcaaggaagcagggatagccaggttcccacagcctgagtggccactacataacagctgatggagtagaggcctgaggaaagcagatggcactgggccctacctccagggtagaggaactgatatatctagattggcagcgtgtgaggttggtgactggtccacctgctcctggcacacctttgtggaggtggccgcttgctctttgagccagtttggccttgctggcatgcacaggcctcagtgcaacaactgtgctgcaaatggagccacatggaggaaatgagcagcaggctcaggagcaggctgtgtgctgcctttggggctccagtccatgtatcagttctcacacagcactgagggcttcttgggtgccaagaggcagaccacaggtcattttgaggaggactttatgtccagatgcagaaagggcccaatctggtggatgaaccacatgccagcttctgggtgcaggcacagtgccacatcttccatcacttcctgatatgtgccccaccagcactgaagagacagcctggaaacaggacaatataaaggctgagaagggtgagatggtgagtgccagcttccaaatgaccctgagtccacccccatggtagccttcaacctttaggaatcgaatgctacaccaagaagatggacaacagggcactcaactcaacttcacagccaatgagttgacatgcaagcagatgatggtggcaggctttaagaaggagcatcagaaggcaggcagtttttcttcagcctcagccaggccttggagctggaccaggccatccacttcaccagaggtgccagcaacaccatcagtgagctctctgccaatctgtcccaacaaggcctggaccccatgatgcacctgttattgttgtctcagggacaccagtccaacgtcctggacatcatccatgtacccaaggaagctcttgccaaagtcatggaaagcaggcaacatgtggcagaaaggaagcagaagtgcagaggctgatgacatcaggatcacggtaacaggatttatttggccactttggctgaaattcaccacttccatccaactaaattgagaaacttgaaatcacaaatgcagtatttcttgcaacaagagatactatttttccaaaaagtcacccaggaattgagagtgttgaatgactagatattcaactgcggactttttccagttcaaggataccttctacagcagaataataacactatcaaagagccagtgccagctattgtggtagtacaagtattgttttgtgttagactaaaacccagctgaatattgacttgtgcaggaagcagttaatatggtgatagaatagaaacagcaccaaactaaatcatactacaaatgcttacactacctttgtaacttttggaagaatgataataccatttacttcattgctttttgaagtatgaatattttagtgtatatgctgtagaccttatatttatgaaaagtctcaaagaagctggctggataaagcctgctgtagatggttttatactgaaagattgatgatatgattcaaatatgtgtccccaccaaatttcatgttgaattatgtttcctaatgttgaaggtggaagctggtatgaggtgattgaattatgaaaacaaatttctcatgaatggtttagcaccatcactttgctactctccttgtaatcatgagtgacttcttgtgagatctggtcattgaaaactctatgccacctccttactttccatgttttcctcttgccatgtgagaaaattcagtctttgtcttccacaatgattgaaagatttctgaggcctcccagaagcaaaagccactgtgcttcctgtacactgctgaatcaagggtcagttaaacctctgtttcaaaataaagcacacagaaaatggcaaatgaggattgaacgattgctatgaagatacctgaaagtgtggaagtagctttggaagtaagtaatgggcagaggttggaagatttgagatggctcaagtgaagacagatagatgggaaaatttctggaccatcttagagactgtttaaatggttgtgaccaaaatgctgacagaaacatggacagtgaaggccaggctgagaaaggtctcagattgaaataagaagacttcaagaaaatgtcttccttttggatacggaaatcttacacaatgcctgtaccactattgtaccttagaagcagtgaacttgctttctatttcagcacctcataggcaaaagagactgtagccttggctcagatggtactttgcactttctaactttgagttaatggtggaatgagttaagaatttgggagactgttggcaagggatgattgtttttgcaatatgagaaggacattaaattcgtgggagggacagaataatatggtttatctctacttccctaccagaactcatactccctaatgttagaggtggggcctaggtagaaaaagatttaatcataaaagggtgagggtggatccttcatgaatggtaaagcaacatgcccttaatgctgtcctcctgatagtgagttctcatgagatctggttgtttaaaagggggtggaacctcttttcttgctctgccttgctcccactcttgttgtaggagacatctcattgtccctaagctgtctggtgtgattgggaagctctctgactcttcccagaaacagaagacacaatgcttcctttacagcctgcagaacactcattaaattaaacctctattatttatgataatacagaaatttggtactgcagaggggagctgtgaaatgtcttcaaggccttttcccctttgacttggctatcagcactgggcttctttatgtgcaaatttctgaagacttcttgaatttttccccttaaatggggttttgtgttattgctacatagtcaagctgttacagagatacctgaaaatgtagaagcacgttcagaagtgggtaacaaagaatgggagagtttggagggcttagaggatgacagaaaaatgagggcctggtgagaatgatttgatcatgaacaggaggtgggtgagagtggaagaaaaaaggggtgggtaggatggggagaagtaggttggcagtagggtggtgggagtgtggagggtagtaggaagggggagtagcctgctgtagaggcagagcctcatggaaaacctctattagggcgttgcacctgtggttttgcagggtttagcctccatggctgctctcatggacggggttgctgttgagtgcctgtagcttttccagactgagggtgcaagctgttggtgggtatatgaatctggaatctagaggatgctgatcccctttgtggaagctcaaagcccactattttccttccgcactgccctagcagaggttttccaagaggctctgcttctgcaacaggcttctgcctagaaaccatggtgggtgagggtggaggatggatcctttactaatgggtaagcatcatcttcttgatgctgtcctcatgatatagagttctcatgagatctggttggattacagggtgtggcaccactttcctctctctgtcttgctccttttcctgccatgtgacacatctccttgccccttgaccttttggtatgattgggaggtttcctgattccctccagaagtagaagccactatgcatcctttacagcttgcagaaccatgagccaattaaacctcttttctttatgatcatacagaaaatatagtaccttgaagtggacctaggaaatgacttcaaggacttttctccattttcttggcaatcagcagtcagcttgttttcatgcaaatatctgaagcctggttgaattttccccctgaaaatggatgtttcttcttttacgacattcccaggctgtgacaaagctggaatgtagaagcaggctcagaagtgggtaatgaacagaggttgggagaatttggagagtttagaagacaggaagatgaggaaaagtttggaccactgtagagcattttactagtcatgttcagaaggctgacagaagcgtggatagtgaaggccagactttgaaagtctcagatgaatatgaaaagcttactgggaacaggagccaaggtcacttttgttttgccttagcaaagaaggtgtctgctaggtgaacctgccctggagattggtgaaagtttgaacttgctggtgatcatttggggtgtaactagcagaatgaccttctaagcagcaaagctcaagaggtatcctgtctgcattgaacagcctgtgctcttaggtgtgatcaaagaaatgacttcaagttggaaattatacttaaataagaagcagagcttcaaagttagaaaaatctgcagcctccttaagtggtcaaaaacgaaagctgattttcagagggaaaatccaagaaggctgtagaaatttacgtaaaatggagtccagtgctaatagccaaggcaatggggaaatggccttgaaggcatttcagagacctttgtagcagcccttgctgtcactggccctgaggactgtgaaagaataatggtttcctgaaacagccacatggcctcactgctgtgtgcagcctcaggacactgctgcctgcatccctgcagtgccagctccagctctagcaatggctgaaagatgcacatgtacagcttgggtcacagctttggggcctgcaagctataagctttggtggcttccacatagtgttcagccagcgggtgtgtagagcatgagacaagaggctttggagcctttgtatagattttggaagatgtatggaaatgcctgggtgtccaggcagaagactgccaaaggaggagagcctcatggaaaacctctactagggcagtgcagaaggaaaatatggggttggagcctccacactggaggccaccactctcaaaacctcagattcatacacccccaacagcttgtacccttagaggggaaaagctacaggcactcaacaccagcctagcccatgagagcagccatggtcactaaacagtgcaaagacacaggtgcaggtctgcccaaggccttgggagcccagccctcacacccctgtgctctggatttgggacagtgaagcaaaaaggatgattttggagctgtaggattgaaagacttgactgctgtgttctggaatttcatgaggcctgtaagtctcatctgcttttgttctttctggcaaaattcttccttttggctgggaatgcttacccattgcctgtgcaaccattgtaccttggaagtagataacttgctttatatttcagaggctcatgggcagaagggagtgtagcctgtgtcagatgagattttaagctataaacaattatgtaaatgctggaaagggttaagatttggaggactgtagggaaggcaacattgtattgtgcaatgtgaggaggacacgagatattgggggccagggcaaaataatatgattttgctctgtgtccctaccaaaactcatatggaattgtcatcgggaatgttaaaagtggggcctggtggaaggtgatgtaatcatggatgagagtgggggttggaagttgggaggtggttgggagaatggcagggattatggtggtgggggagggaaaggtcggggtggtgtgaatccttcacaaatggttaaacaccatctccttcatgctgtcctcatgatagtgattctcatgatgattttggagctgtaagattgaatgaatagtggctggctggattttgggcttgcattgggcctgtggtcccatttgtgttattttcctgggaaatttcttccctttggattgagaaagcttacccaatacctgtaccatcattgtaccttggaagaaaagaactcctttttaaattcagggactcatttgcagccttatcttatatgagacaatgaactttttacatttgaattaatgctgaaatcagttaagatttttggaaacttttgaaaagaaatgattgtattttgctctgtgagaaggacatgagattcagaagggtcgaggtcagaataatacggttagggtatttgtccctaccacaactcatgtggaattgaaatctcaaatgcttgaggtagggcctggtgggaggtgatataataatggaagggaggggggtgggggtgcaaggaaaaaggggtgggtagggtggggaaaagtaggttttcagtagggtggtgggagggtgaagggtagtaggaagcagagtagcctgctgtagagacagagcctcatagaaaaactctactagggcagtgtgccgtggattcacagggtttagcccccgtggctgctctcatgggctgggctggtgttgaatgcctgtagctttttcacattgagggtgcaagctgttggtgggtctatgaatctggggtctggaggatggtggccccctgtgtgggggctccacgcccatattttccttctgcagtgcccgagtagcagttttccaagaggctcggcctctgcagcaggttctgcctgaaaacagtggtgggtgggtgtgggagaagatccctcacccatggttaaccaccgtcttcttgatgtgggcctcatgatagttctcatgagatctggttgtataaaagcatgtggcacctctttcctctttctgtctttctcctactcctgccatttgaaacatctcattgctcctcagccttctggtatgattgggaggcttcctgggtcctcccagaaacagaagccactctgcttcctttacatcctacagaaaccagagccaatttaacctcttttctttatgatcacacagaaaattagtactgcaaagtggagctatgaaatgccttcaaggccttttcttcattatcttgcctgttagcattggcctaccttttttatgcaaagatctgaagctttcttgaattttctccctgaaaatggggttttcttcttttaccacattgccaggtgtgactaaattagctgaaaatgtagaagcaggttcagaagtgggtaacagccaaaggtcagagagtttggagggctttgaagaagatagggacatgacagaaagttggacctattgtagaaatgttttaaataattatgattaaaaggttgacagatgtatagtgaaggccaggcttagaaggtctcagttgaaaatgaggaagttatactgggaataaaagcccaggtcacttttgtcttaccatagcaaagaacttagccgactggtgaccctgccctcaagatatgtgaatctttgatcctgagggtaaagatttagggtgtatctgggtggaatgaacttctatgcagcaaagctcaagaggtgtcctgtctgtgtcaaacagcctgtgctcttacgtgtgactgaggaaatgacctcaagttggaactcatatttaagtgagaagctgagcttaaaagtttggaaaatttgctgctggccaagtggtcaaaaagaaaagctgattttcaggagggaaaatttaagaagtcttcagaaatttgcataaaaaggagcccagcgctaatagccaagacaatgagaaaaaggccttgaaggcatttcagagacctttgcagcagcccttagtgtcacaggccctggggcctaagagagaagaatggtttcctgggccagacccatggccctgctgctgtgtgcagcctcaggacactgcaccttgcatccctacagctccagctccagcttcagccctggctcaaagatgcacaggtacaacttgagtcactgcttcagagggtgcaagctataagccttggtggcttctgcatagtattaacccattgggcacacagagcccacgactagagtcttgggatcctcctcaaagacttcagaagatgtatgggaatgcctgtgtgtccaggcagaagcctgcccaaaaggaggaacctcatgggaaacctctactatggaagtgcaggaggaaaatatgggttggatcccccacactggtttgtcattgggaatgttaaaggtggggactggtggaaaatgatttaatcatggatgagagtggggactggaaggtcgggggtgaggagaatgggacggatgatggtgggagtgggaggtgaaatttggaagtgtgggggggatccttcaaaaatggttaaacaccatctccttaatggtgtcctcatgatagtgatttctcataattattttggagccgttagatcgaatgattactgtcttgccgggttctggacttgcattgcgcctgtggttgctttcgtgttatttttgtgggaaatttcttccttttgattgagaaagcttacccaaagactgtaccatcattgcaccttgaaagaaaataactccttttgaattcagggactcatcaacagaagggactgtagccttgtctcagatgagactttgagcttttaacatttgagttcacgctggaatgaattaagacctaggaaacttttgaaaaggcatgactgcattttgctctgtgagaacaacatgggatttccaggggtcaaggtcagcataacacggtttgtctgtgtgtccctaccaaaccttatgtggaattgtaatctcaaaccccagaggtggggtctggtggacggtgatttgatcatggatgggagtggcgtgggggtggaatgaaaaagtggtaggtggggtgaggaagagtaggtttttcagtagggtggtgggagggtgggggtagtaggaagtgggagtagcctgctgcagaggcagagcctcatggaaaacctctactggggcaatgcacctgaggctttgcagaatttagctcctgcagctgccctcaagggctgaactggtgttgagtgcctgtagcttcctcacactgagggtgcaagccattggtgggtctgtgaatctggtgtctggaggattgtgtcctgtgcgggggctccaaacccatattttccttctgtattgcccaaatagaggttctccaagaggctctgtctcttccataggcttctgcctggaaacagtgttggttgagggtggggggtatatctttcacctatggttaagcaccaccttctagatgctaacttcatgatagtgagttctcatgatatctggttgtataacagcatgtgacacatttttcctctctctgtcttgctcctacttctaccacatgaaacttctcattgcctcttggccttctggtatgattggcaagcttcctgagtcctctcagaagcagaaaccactctgctgtttttacagcctgtagaaccctgagcaaattaaacctcttttcttggcctggcatggtggttcatgcctgtaatcacagcgcttttggaggctgaggtgggcagatcatgaggtcaagagatcaagaccatcctggcaaacagggtgaaaccttgtctctactaaaaaaaaaaaaaaaaaaaaaaaaccaaaaaacaaaaacctgggcctggtggtgcacacctgtattcccagatactcagcagactgaggcagcagaatcacttgaacctgggaggtggaggttgcagtgagccaagatcggaccactgcactccagcctggtgacagagggagattccatctcaaaaaataaataaataaaaataaaatactcttttctttatgatcataccaaaaattagtattgggaagtggagctataaaatgccttcatgaccttttccccattgtcttggctattagcactgggctgcttttatatgcaaatatatgaacccttgaattttccccctgaaagtgaacttttcttcttttaccacattgccaggttgtgacaaagatcactgaaaatgtagaagctggttcagaatattggtaataaagctcaaaatcctgaggaaattgaacactcaaataaaggattcttagcaaagcaattttacttctgcacagaggggtgcttctccttggccagtcaccatgagagcacatctgaacaaaggggcatgagagcctttattcctgatgcaattcctgcccctgtacccttttcccattggccagggtcaggtcacacaatctgaactaatcctggttggctaaacatttgaactttctttagataaagtgggcacataagggagagaggggaaaaggggaaggggtgtctgcaatgacctagagaggtagtcttttttccaaataaggaaaggaatgtgaacttgtactgataagcctggtactgtggtgtgtctgggcatgtaacaaaggcagaaaggaaaaaagacaaaaaggaaaagggggtgagcatgggtaatatgaatgaataaaggattgatcaggctatttgaagagaaacctcatcatatcacacaagaagtgagtaatggccagaggtcagagagtttggagggcttggaagaagacaggaacatgagggaaagtttgactcattgtagagacttgttaaataattttaattaaaaggctgacagaaggacatacagtgaagccaggcttagaaggtctcagatgaaaatgaggaacttactgggaacagagccaaggtcacttttgttttgccgcagcaaagaatgtggctccacagtgaccctgcccttgagatctgtcactctttgaacttgagagtgatgatatagggtgtatctggtgaaatgaacttctaggcagcaaagttcaagaggtgtcctgtctgtgtcaaacagcctgtactcttatacgtgactgaagaaatgacctcaagttgggactcatatttaaatgagaagctgaacttaaaactttggaaaatttgtagcctggccaagtagtcaaaaacaaaagctgattttcaggagggaaaattcaagaaggcttcagaaatttgcataaaaaggagcccagtgctaacagccagggcaatgaggaaaaggccttgaaagcaattcagagctctttgcagccacccttactgtcacaggccctggggtctatgagagaagaatggtttcccgggccagacctatggctccactgctgtgtgcagcctcagttccagctccagccatgggtcaaagaggcgcaggtacaacttgtgttactgcttcagaggatgtattctataagccttattgtcttttacatagtgttaagccagcgggcacacaatgcatgagtctacaggcttgggagcctctgtctagatttcagaaaatgtacagaaaagcctggatatccaggcagaagactttccaagaggcagagcctcatgggaaacctctgctagagcagtgcagatggaaaatatggggttggagccacccctagaaccttgggtctggaagcaggccaccatcttccagaccccagattcatagacccaccaacagcttgcaccctaagtgtgggaaagctacaggcactcaacaccagccccagtctgagagcagccacagaagctaaaccctacaaagccacaggtacaaagctacccaaggccctaggagtcccactctcagtcctgtgtgccctgggtgtgggatataggttcaaagaagatgattttggagctgtagtgtagcaggagaagcctcagacaaaacccctcagataccaagttaaagaaggaagggatttatttggccgggagcttcagcaagattcatgtctccaacaaccgagctccctgagtgagcaattcctgtcccttttaagggctcacaactctaagggggtccacatgagaaggtcgtgattgattgagcaagcagagggtacgtgactgggggctgcttacaccagtgattagaatggaacagaacaagactgggatcttcacagaacttttttaacgcaagtaactgattaggtcggggtcgatctttaactaccagacccaggatgtggcgccaggctgtctgcttgtggatttcattcctgccttttagtttttacttcttttttctttggaggcagaaattgggcataagaaaatactaggggtggtctcctcccttagtaggattgaatgactggcctgctgggttttggacttggaaggggcctgtaaatctcagctgtattttgttctactttctccaaaattcttccttttgaatttgaaacgctttcccaatccctgcagtcattgtgtcttggcagtagttaactcgctttatatttcagagactcatgggcagaaagaactgtaacactgtctcagatgagactttgggctttggacatttgagtaaatgctggaatgagttaagatttgggggactgcatagaaggcatcattatatttgacaacataactagaacacgagatttgggggccagtggcagaataatatggttttgctgtgggtcccttccaaatctcgtgtggaattgtcatcctggatgttggaggtgggacctagtggaaggtgatttaatgatgttctggagtgtggggtggaaagtggggaaggagtgaggagcattgtgaggagtatggtgggtggtggggagtgaaatgtggggatgggatccagatctttcatgggtgctaaacaccatttccttaatgctgtcctcacatgagtgagttcttgtgatgattttggagctgtaagattgaatgaatactgtcctgctgagttttggacttgcattggttctgtggtctcatttgtgttatttttctggcaaatgttttctttttggattgggaatgcttatgcaatgcctatatcatcattgtatcttgaaggaagagaactttgtttttaattcagaggttccttggcagaagggattgtagccttgtctgagatgagagtttgtactctatacatttgagttaatgctgaaatgagttaagaatttggaaaacatttgaaaatgcatgattttgttttccattgtgaggaggacatgagattttgggggccaaggacagaataatgtggtttggctgtgtgatcctaccaaaactcatgtggaattgtaatctcaaatgttggcagtggggcctggttgggggtgatttaatcatggacaggaggatggtggacctggaaggaaacaagagtggataaagcagagaggagtaggttggtagtagggtggtgagaaggtaggggttagtagaaagagggactagcctgctgcagaggcagaggctcatggaaaacctctactagggcaatgcatctgtggcttttcagagtttaacccccatggctgctctcatgggctgggctgatgttgagtgcctgtaagtttttcacactgagggtgcaagctggtggtgggtctatgaatctggggtctagaggatggtggtctcccacgtgggggctccaagtccatatttttttctgcattgccttagtagaggtttttcaagaggctctgtgtctgcagccagcctccgcctggaaagagcagggggtgggatgggggttgcattcttcaccaatggttgagcaccatcttcttgatgctgacctcgtgagagtgagttctcatgagatttgcttatataataggatgtgacaccactttcatctctctgtcctgctcctccttttgccatatgaaatatctctttgcccttggccttctgttatgattgggaggcttcctgagccctcccagaagcagaagtcactgtgctttctttacagcctgcagaaccccgagccagttaaacctctttttaaaataacatggcagaaaactagtactgtagagtgaagctatgaaattccctcacggccttttcctccttcttttgcatcagcacttgcctcctttcttattcaaatatctgaaaccttgttgaattttccccctgaaaatggatgtttcttcttttaccacattgccaggctgcagcaaagataccttgcaggttcagaagtgggtaaaggacagacaatggagagtttgaagggcttaagagaatacagcgaaatgggggaaactttgaaccactgtagacttgttaaatagttgtgatcaaaaggctgaccgaagaatagacagtaaagaccaggattagaaggtcttagatgaaaatgagagagttactgggaacagaggccaaggttagtttgttttgtcatagcaaagaatgttgctgcatggtgcccctgtccaggagacgtgtgaaattttgaacttgagggtgatgacttaggtagtatgtggtgaaatgaacttctaaggagcaaagctcaagaggtgtcctgcctgcattgaactacctatgctcttatgtgtgaccaaacaaatgacctcaagttgaaatttgtgtttaaatgaaaagctgagcttaaaagtttggaaaatttgcagcctggccaagtggcaaaaaaaaaaaaaaaaaaaaaaaaaaaaaaaaagctgattttcaggggggaaattaaagaaggcttcagaaatttgcataaaaaggagcccagtgctaacagccaagacaatgggggaaaaggcttgaaggcatttcagagacctttgcagcagcccttggtatcactgaccctgggacctatgagagaagaatggtttcctctaccagacccctggccttgcttctgtgtgtagcctgaggacaccactgcctgcatcctgcagctccagctccagctgcaactccagctccagtcatggttcaaagatgtacaggtacagcttgggttactgcttcacagggtataatttgagggggaccaggggcagaatcatataatttggctgcattttcctactaaaactgacatcatatcataatatttcatgttggtggttgggtctggatgccaaggtgaggagaggtgaaaagtggggatggtgttcagagtttgcaggactagagtggtgggctcggagcttatttggagagaggggtattgtacattttcagggcatgggggtggggcgcagattctttaccaatggttaagcaccatctccttgatgctgtcctcatgatattgagttctcatgagatttgcggggttttttgtttgtttttttttatagtgtgtggcaccactttcctctctctcttgctcttactttggccatatgggacatctctttgctccttggccttctgggataattgggaagcttcctgagtcctgccagatgtagaacccactttgccttctttacagtctgcagaaccatgaggcaattaaacctcttttctttatgatcatagagaaaattggtactgtggagtggagctatgaaatgccttcaaggccctttttccattgtcttggctattagcactcaggttttgttttatgcatatatctaagccttcttgaattttacttctgaaaatggacttttcttcttttacctcattacctggctttgacaaatatacctgaaaatgtagaagacagcttagaagtgggtaacagacagaggcagagagtttggaggtcttagaagaacagaataagataaaagaaagtttggaccattgtagagacttgttaaatagttgtgattaaaaggtcaacagaagaatggacaatgaaggccagagtgaggaggtctgaggtggaaatcaggaacttactgggaacagaagcaaaagttacttttgtttggcattaacaaagaaagtgactgcatggtggccccgccctggagatctgtgaaactctgaacttgagggtgatgatttagggtatattcggtggaatgaacttctaactagcacagctgtagatatgtcccacctgtgtcaaacagcctgttctcttatgtgtggaccaaaaaatgacttcaagtcagaacttacctttaaatgagaagtggagcttaaaagtttggtaaatttgcaggcttttttctcaagttatgcatttttagaatgacatgaggtttggagggacggggcagggtaatatggtttggcttcatgtccctgccaaaactgatgtcaaattttagtttttaatgatgaagtttggacagtaggtgttgatggactcatgtgggtgggttattaatgaatggtatagcaccatccccttgatgctgttttcatgatagtgagtgagtttttatgagatctggttgtttataagtgggttgtacctctttttctgttttgcttctgtgcttattatatgagatgtctcagtcttttttttgccctcctttctgacttgaagtttcatgaggcctctcagaagtggaaactactatgctttttatacaagctgcataactatgaggcagttaaaacttattttcacatgataacactgaaaataggtgctgaggagtgaaacacttgactaaagatacctgacaatatgggaagaggtttgggtctgggtagtgggcagaggttagagtttggcatgctcagtaggagatggggatttaaggggaattttggaacatctttgagattgtttaaatgattatgatcaaaatgttgacagaaatgctgacagtgaaggccaggttaggtggtctcatagggaaatgaggaatttagtgggaattggaacaaaggtcacttttgtcttgccttagccaaaaatgtggctgctttgtgcccattttatagggatgtttaaaactttgaacttaagtgtgataatttagaatatctagcataataaatttataagcagtgaagcattcaagaggttgtgtgtctgcttctaattgcctgtcttcatatgagtgagcatagaaatgacctaaagtgtgaatttatatttaaagagaaagcagagattaaaagtttggaatatatgtagtctggacatgtggtagaacagaaagcccatttttaggggagtaattttggatgacttcagaaattggcatatgtaaaaaggagccaagtggtaatagccaagacaatgggggaaaggcttccaaggcatttgagagagctttgcagcatctgctttcatcacaggttctgaggcctaggaggaaagaatggtttcatgggccaggcccagggccttacatccccgcacagcctcaagagaccgcttcttgcatttcatctgctttctctccagctcaagacatatgtcaaaggggcccaggtatgactcattttacttcatcagatgtttaaagccagaagccttggtgacgtctatggtttttttttttttttttttttgagacggagtcttgctctgttgcccaggctggagtgtggtggcatgatcttggctcactgcaagctctgcctcctgagtttatgccattctcctgcctcagcctcctgagtagctgggactacaggtgcccatgaccacacccagctaaatttttgtattttttagtagagatggggtttcaccatgttagctgggatggtctcgatctcctgacctcgtgatccactcaccttggcctcccaaagtgcagggattacaggcatgggccactgcacctggccctctatgtggttttaagtctgcaggtgcacagagtctgcaggtgcacagaggcttggagcctccactcggaacccccacctagattttagaggatgtatgcaaaagactgagtgtccaggtaagagctgactctagggatgtggctgttatcaagaatctcttctagggcagtgcagagggaacatgttgggttgagcccccaacacagagtttccaccggggcactgcctaatgatgctgtgagaaaggagctaccatcctccacatcccagaatggtagttgcaccagcaacctgcaccctgagtgtggaaaagccactggcacttaatgcctgctcagcttgttactgcagacatgggggtggaaccctgcaaagcaacaggagtagagtggcccaagcccttgggagtccaccccttacaccagtgtgtcctcaaagtgggacatggagtcaagattattttggaacttcaacattttatgacagccctgctaggatttagacttgcatggggcctgtagtcctgtggggtttttttaagcaaattttttccttttggattaggaatgttttgccactgcctgtacccttattatatcatggaagtaactaactcatttttttattttacagtctcataagagaatggaagtctagccttgtctcagatgagactttgaactttggacctctgagttaatgttggaatgagttaagaatttgggagagtattgggaaggcatgattgtatttttcaacgtgagaaggacatgagattgacaggtcaggggcaggataatatgatttggctctgtgcctctcccaaaacttgtgtcaaactcatgtaatccctaatgttggaggtggggcctggtggcaggtgactgaatcataggggtggatgctttattaatggtctaccatctttgtttctgtcttgatcctgctcccaccatatgaaacatcttagttctcctttgccttctgccatgtttggaaggttcctgaggtttccccagaagtagaagctgctgtaattcctctacagcatgagccaattaaacctcttttctttatatgttacctagtctcaggtatttctttatagcaatgtgagaacatactatacaattgaaattacctaaattcagtctgttctctatttaggtcctagagcagcattgctactctgtgcttttaaatttatctgcacaccttttttttcttagtgaaaggctgaaaggtgagtacacataaaacagagtgatgatcatacattggcagtggaggttgtgggatcgaggatcagctgccaacaaattggacagctagtattatgatctgataaaatgctgggacatgcagaggtgtgagattcagtgcacatcttttacatgaagtctgttagaaaagaaataatgcactgtgttcccttagaggcagctgtagcatcatctcgtcatgcaagtgtcctgaaacttagtttgataatttcagcaaatgtgtcttctggcatgagaaggaggattctcttctgtcagagaattaaagtgtagaagcagtgatgacacgcacttggtttcagttcttaggagagtttcgtttttgatgttttagcttgaagattttccttcagtagtgtttttaaaatgaatctatactggtaactgataaagactctactatgcaattcactcattgaattaaaaaatttccaaggttgtctgtaaatctcagggttctatgtcatgaaaactggtatcggttgatgtaaggaggaaccagaaataatttatttccagtactgaagaaaaaataattgatttatagtttgatttttaaaaagtattgataagtccccagaacatttaatcttgaaaatattttaaattttaaaaggattataatgcaaataaaaatagctgataaatatgaagattcaaaaggagcttaatttaaaaagcacaaagagattgtcttgcattgctgaaatctcaatatttttatagttcctgggctaaataatttgatgttgagtttacagatttaaaaactgtggctgaaaggttaaagtctctactatttatatgaagtccaacttatgctgccccaaatccctgggtactgaaattgtaacaagtcaaattgaaacactgatgaataacaatgatgaaataaaatgatccgtttgcagatagtcataaaaagaagagattactaaaatcatcatgcagcagcacattgactctcagaagtaatttcttatgggttgaattttaagatcagattctcataattttgatatttgctcaaaacttcgtcccttaggttacttagagccagatttaacatcaggtggtgttgtctgtactacacacatgtagactgtaaccagaaatattgttctctaaaaacaagatcgaacaactaccaaaaactaattcagctcctaggactgaagaaaactgggcaagtgaggttcaggaggccaggtgcctacctctgccatccttggcagttgcattttatggtaagaaaacatcaagatggcaccactcactgaaaggaggctccaagttgggaaccagaggtaccagcttagattccttaatccctaagaaggcctccctctcaaagacaaagaccccttccttggcctcaagtcctcattcttgttggttaaacacaattaattcttcatcattatcacctgcctgttttttgacttgcccagagctctgaaggaaaccctggacactctgcggcaagcgcgaagagagggctgtgcagcccaggcccctgatcagcttctcccagcctttccctcccaaaggctatagcagggctgagtgccaacatggacctgcagaggcctgggaggggagcaaatggctggggttcttgtggcatttgggatgttcatgacagttagtgcaaagcatccatggcaggatctgttgtcacctctctccaccatccctggattgccaggctccagtggcctttctttcctctcttcttctctgccctccctccctccatttcctccctccctctctcttcctctctctccttctgtcttttcttccctcctgttttccctttttcttccttcacatctatgcctcctcccagtatctggcagccccatgtcctcagcctgtgctgggtgagtctgatgaactcagacaggatgtataggaggggctttcatcagttcatcctgggcagctgttctagaagtgactacgatggggcaaatgcatgggtacgtgtgtgtgagtatgcacaagtgcgtgtgtgtgcctgtgcatgcctgttgaccacatgtcttctctaagtttgtgtccataactccagaggaccccaggtgtgctctcgatgtcatgttcagggatcaagcacagctcctgctggtgggaattgcactgtgtgacactttcctcagggacctgggggtgtcagatcccagtagtctcccagtaggctttcagataggtcagaaagatgttctattgttgttttattttctttttttcatccatggttttactaccttcttcttcttagtgatttttcatgaagggacatctgggttggggaaaggtagctaataagaaatgatgtcaccataaaatagcaaagagtctcctggctctgtggggacagtcttcatatggtccctggcccagcctcgagggccctggtccagtcaccttatggcctctgtgctgtgtccctagatctgggctctgtgggaaagaccctgggagacccagcagaatggagtaccttgtgtgccaaatgtcccccctttactctggctctatgactctttctccctgtgtcctggaggagaggacctgtctggagaagaccctcagggcctggccctgtcgattaagataggagggaagggtctgtggcctgaggcagggcattggaagggaattttgagcactgctgctcaggtgcctggtcactgggacccagtgtttcccttgtcagcaggggcctggtcagtgggactgtggtcaggggactattgatcagtgtggcctattctgtgaggacatggttagggggaacctggtcagtgggaacatttttagggggatcagtcagtggggaccaggtcagtgaggacctggtgagcggaggcctggtcagtgggacctgggcatcggggcctgttcagtggggacctgctcagtggagatgttttcactgtggtccccctcagtgggacctagacagtgggggcctgatcagcgagacctggtcagtggcaacctgatctgtgggaacgtggtcactggggacctggttaatagaaacctggtcagtgatggcctaatgagtgaggtcttgatgagtggggaaccttgtcagtgaaggcctactcagtggggttagtcacttttgacctgacagtgagcacctggccactttggccttgccagtgggggcttggtaagaggggcctgatcagtgtgggcctgcttagtggacctagtcagttgggacattgtcagtgaggtctatttagtggggtcctggtcaccatgggctgggtccctgatgaccaggtcatggggctctattcagtggaggcctggtcacatgggacctagtcagcagggcctggtgggcatgtcctcatcagtgaagcccttgtcagtgggtccatggttagggcatcctggtcaatggatcataatcagcaagggcctggtcagaagagaattggtcagaggggacttggtcagtggtggcttttgtagcactggtctaatcagtggtgacctggtcagcggggatctgagcagtgagtgcctgttcagtggggcctactcactagggttctagtcatggacatctggccacctcaggcctggccagtaggggcctcatctgtgggaccaggcaatggggtcatgattggtggaacctggtgactgaggccttgtcagtaaggacctggtcagtggagtcctggtcagttaggccttgtcagtaaggtcctgggcagtgggtcctggtcagtgggttctggtcattgtgggcctggcagtgggggcctggtaagtgtggcctggtgagtggggtataatcagtgagggtgtggctagggaggaccagctgtgcagggtctggtcagcagggacctggtcagtgggggctgctgagcattgctgggagatgtcaggtgtaacatgtgttattgatggtcctgtagacacctgggatggcccagtggtgcccaacagcccagttaaaagtggacaaggcaggtgtttggatggacttgggaggtcttgctcagagattccgacagaataaaggtaaagaagggccagagtggctggagagatggtcacagtctgtgggctacacaggatggaggaagtcagggtgttcccaggcaaggtgggtagctgggatgcagggagaggcaggtggatgctgagaggtcagatcctgcgagggctctgggggcatcaggtaggatgggctcttgtagggtccatccccacagggtctgtgggtctctccccgtgtgcagagatgagagagtgtagaaataaagatacaagacaaagagataaaagaaaaggcagctgagcccgggggaccactgccaccaagtcactgagaccggtagtggccccaaatgccaggctgcactgatatttattggatacaatacaaaggggcaggataaggagagtgagccatctccaatcataggtaaggccacgtgggtcatgtgtccactggacagggggcccttcccttcctggcagctgaggcagagagagagaggagacaaagagaaagacagcttatgccattatttctgcatatcagagacttttagtactttcactaatttactactgctacctagcaggcagagccaggtgtacaggatggaacatgaaggtggactaggagcgtgaccactgaagcacagcatcacagggagatggttaggcctctggataactgctggtgagcctgactaatgtcaggccctccacaagaggtggaggagtagtcttctctaaactcccccggggaaagggagactccctttcccggtctgctaagtagtgggtgttttcccttgacacttacgctaccgctagaccacggtccacctggcaatgggcatcttcccagaagctggcattaccgctagaccaaggagtgctctggtggccctgtctgggcataacagaaggctcgcactcttgtcttctggtcactcctcactatgtcccctcagctcctatctctgtatggcctggtttttcctaggttatgattatagagagagaattattttaatattggaataaataattgctacaaactaatgattaatgatattaatatataatcatatctaagatctatatctagtataactattcttgttttatattttattatactggaacagctcgtgtcctcggtctcttgcctcggcacctgggtggcttgccgcccacaggctctgtgcaccatcagtgcactgggcaggtctcagcccaggctccctggaccctggccaggtgatgtggtcactccatgggggactgctgtcatgccctggccacccaccctgggcagcacagtcttatctcatgattggcctttctctgatcctgcagagggcacagctcgcagcccaggaggggcagtcccagggtgcagcttgagttctccacgggcctgaagcatcccctgccagccctgtactttctcttctcccaggtctcgcttttccagtgtcacccagcaggaaggccccatcctcccttccttgtgtgtctcctaggctgagacctgtggtggatggggacagggagagtacttcctcaggtccacttggggaggagacttgctcccagcctggtgaaggtagtcagctttaccttggttgccttagaatgagatggatctgcccccttttagtgccctcaaggtgaaggtgagagacggtccctgctgtgcaggaggttggtttagggatggaggacttggcaggtcctcccagactgtcaggcttgggcagcactatccaatttcaggactcagaaagtccagccctgagacgggactgtgctgcccagggtgggtggccagggcctgacagcagtaccccagggagtgaccacatcacccggctggggtccagggagcctgggctgagacctgcccagtgtgctgagggtgcacctggagcccaccccacctgacactcccacatcctcacaggttcttctctcctagcatgcacttgcctttccctgctcctcagcagcccactctgcctcttccctgacttcctccatggtgtccagcaggatgggctggacaggggggcagcctgtgtgcacattttgtggaagtgggactaacacacactccctgggaggcaccatggttcctgccaaatccaaccccagaactctgtccctgaggtggttttactaaaccctaaactcagaactgtggctgtggctcaggggtcagcacctgctagtgccaagacactactgggagtgtgggaccttagcaaaccccatggtgtctggcctgaggacagggtgtcttggggctgagacaaacactggggctgagaccgtctgacccaactggccaccaatggccattgggtcagatgatctcagccccagtgtttgtccttccctggctccttctggttcagtcccatcaaggccctggagcccaaatcccatcatcaaacatcccctccaggaatcctggccactcaattcactttatcgtgtttcatcgtagagcaaaaatgacagaacagatgcatagaaaaatggcttcagttgcttaatgactagaagaaatctgggagaagcaagaaggtaatgtggagagggagagacctccatgatcactctctgcagagccaggggcacaggcacccagtgcagaggcctgatgccacctgcctctcagagggtgtgtggcacactgtcattacccggaagacatcaggtctggtcaccagcttttctgcctgtcctgtaagcatcaagttttggaagagaatctcatgccagggcctggaacacacctggctcaggggttaggggttgccccttggtaatctaaatgaaaaaaataggtccagatcagagttcctaatgcggagcactcatccactctttgaattgtaaaaggggaggcctggtcctaggtatacctaagatctttgaggaactgaagatcccaagattctggaaaattccagagtcctcaggccctaatcctccctgtcctcctgtggcctgtcccatcagcacactcttctatctgtagatgttttggctgctctgtaagggagtccccctgcaggtttggggctgggcatggtcacccctgctgcatgtcgagaaggtgaaagccaagaacacagggtacagtgtttccacgctcatccagagcaggacaaacaggccaggttgtgtcaggagcccaagtatccagttggtgcaaatgtcaaacctgctgtggaaggaggggtccattgcccatcctaggtacagatggtaatgtagcgcaggtaagctgggcttggtagccctccctagctttggaaataagccaaacaaggagctttctggagaatgaaatctcttttccttccagaagcactcctgaatttttggtgattgccatttgtggcagtgagtttttgtctgttctggggctgggctggtttctctgattggccctgccctacagagcataaaggaaaagtgcaagaggtccccagcaaaaatgtgcagatagccctggacataagccacattctgagaaacatgtcatgttctgagaaggctaaggcatcaagtaaatcatatgggactggaggatcccagggtaggtggggcagttcagagcagtgcgggcttccctgggaattgggagaggcaggggttccagaggagggaatcacagggccaccaagggctctcttggccctgggagaagtcaacataatggattgaacacctgctgggcttcaagccctgggccaggctggggcatgtggagctaggaggcagctcaaattgggaggcagagagagaagtgtgctgagacggcgccgtttctgggtgtaatatggtcctgagattctgtatgggaagtgcttccagggtttcatatgttatggggttgcttcctctccccagcctcaccctgcaggaatcccagtgactatatcgccaccatcttggagctcagtgccctcataatgtaacggcaacagcagatcttcctgcacagggactttctgtactacgtcactgctgaggggtggtgcttctgcagggcctgtgttgtggtgcacaacttcagacaccatcatcctggagcagcactgcaccctcactagccagggagttaataacttcctgaaggtcacagccacattcaagactttggacttcattgatgtgcttgtgctggacaaggtgggcttctctgggatcttaattcaggaggtaggatagagcttgacataaaattcagataaaagaacttgaccttcatctggagggctctggggagccatggaagttgctggaagaaaggtgggaaaactcagataagcttcagtgatgcctgtagaaggctgtctggaaggaataaacaagaggcaggaaaccagggagggagcttgtggggcagatcttgagatagcaagggagggttcctgcttggatgatagttcttcaggggctgtctctgtcttcaggtgtcttcagagctagtgtgttcattggtcttgtctccaggtgaaattgggaagttgtcagataagcacataaaagtggaagctgacatcttcatgagtgctggtgggggtcctggtgtgggactactgtgggaacagggatctctcaatcccagggatgtggtggatgggccctggattactccatcctctatgcttcctttcccctcctcccattctcccgacggcctcagtgcaaaggcactgttcatcctctggtgctgaagcagcctagagtctcaagcctgctggcggcctcgcaggatatgacagcacagccagtggcctcttctgggtcctgtacatcttcacaagacaagtagacatcaggagtgctgccagcacttggtgcaggagttctgagggaccacagtcctgaagacattgaatggtgggtgcagggccttatgtcctgtttcccaccccttctcattggttctgctccaggtggggaagggggaaaaagtttttgccaattctaccattattgccttgcagaaaaaggagcagaggccagaagcagggactggtacccacccgggctaataagggagaatttgtaggctttgtggaaagatctgggagtccatatctgttgtcccactaacttgctacgagacattagtaaaatcagttttttttatgaactacatttctgccatctgtaaattggggcgagatttttctaccccatggggttgcttggataattggtgatggtgtgtgtagagcaggtgccacctggcaggcattcggtgtccagccactgctcttcccccttgctcttctgcctaagtttgcattttcttctcaagaccttcactctccctaatttttctcttacctctgattcccaccttatagtctattccatggattcaccaggatctaagtaggtgacagtaatgtatgcatgtatgcgtatatagggatgtacaccctcacacaccacacctcaacatagtaggtgctcagtgaacatcacactgcagaagcagtgctggtagatctagagtttcacctcaacttgcagttgaaaaatctgagtatctgaaagggcaaatggaagggtgaagtcatggtggcccagtgcccttcctatttgacctggaacaggtgtctcaggatgtttggacaccacattttcaattttgggctggctgcttggtcgggaggaggtggacaagaattagaggctcttcccacaccctccaagccttccccagggtacaagaacagaccagggcaaagaagtcctggagcaggggagagacctttccatagcagaagccatttctgactcagtctctcccagccttttccattctgcctcttccccttgttgtccctgggtcttctatctgctctcagtccatttgcccatccctgagttcttcctgccctgccccagcaccttctcctctgcccctctccaccagccctgcagatccctgggtcctttcttgagcctcaggaactcaccttccatctcatcttccctgaagaatgtcactgctgagcctgtcctggctgggtctcaggtgagtggcagcatccccttgactgctcctgctggctcctggtctggacctacactttctatgacaactgctggtatctctagtgttttctgtagcctctgatttggaactggtttggaggtcacctgggcctggtgactgtagcagcaggctggctctaaggtctcagagtagatcgacttcctgaggggccaggagtggagctctgggagttggggtgagggcatgggctggcatctgggatggcagagaagtgaggaaggtggcttattcattcctctgctgtgccactcaacacctttgtcacctccttgttctctcatcctggcccatatcactcccttcctgcccatgttcctcacattcttgtacccctgaggggctccatggttctgcatagagcatggaacccctggcgtttctacattgatcactactggacttgaagcctcctgaggggcatggtccagtgccttggcccattttctgttatgggacacatgggctggaagagcagtgtgtgtgttctccaccctccctcccagagcatcaagctcttatcttgcctctgctcactaagatgtccccgtgtgtcctgttgcagaggctgaacgaaagctggccactctcttcccctttcagagccttctttggtcttccttccctcctcagacctctgagtcacatctgctctcccattttgggggtgtggcctcagcccatttgtaaatggtaggattgatgggcatgccagttgcagtgggagggtgcacagcacgcactagtgcagagcctggcatgcagaaactgctcccaggtgggagctgccatcctgagggacagttacaatcaacttgtctccactggaggctgctgagaagggaaggtccctggtgtatagaccctgctccctgaggaatcagagctcatggacacccacaaaaacatgaaaggatgtgggttcacatcctgaggccacactgcttaccacagtctcatatggctgtccctgggttgaaaccaaccccaggataagaaaatcttttcctgtagccaaggtgtgtctccctgttggaagagtcttctctccctgctcttggctgtacccttaggtattggaggtgtccctgagagaaaagaagtaggaggaagcagagattccctggatttctacacaatccagacctgctgttcattcggagtctggtccttccacagaggctgcagagggaacctgtgcattactcatggttttccttaatccagaatcaataggatatatttatatctactacctatctatcatttgtcaactatccatccatctctatacctatctacctatctatctgtatccatctatggagagacaaaaaaaaagaagagagaaaaaagaattgactgtggaaatgggctcatgtgatcatggaagtagagaagtcccacgatataccatctgtgggctgcaggaccggggatgttgggggtgtaattcagtctgaatccaggggcctgagaacctggacttttgatgtccaaaggcagaagatggatgcccgaaggcagaagatggatgccccagctccagaagagagtgagttctcccttccttcaactttttgttatattcagcttctcagtggattggatgatatgcgcccacattggggagggcaaatcttccttagtttactaatttaaatgtgaagcttttctgaaacaccatcctagacacacccaaagattgtgtttgaccagtgatgtgggtatccctcagcccaggcaagttgacacctgaaattaaccctcacagaatgtgactgtccctgctttgcatgcaggtcacccccacagagcaaggcttgaggattctgactcagctggtggccaccttcacatgaggctttatgaggtggacaggtctcatctttcctatcatcagtttgtgccccgacattggccatcaatgctacaggtgcccatgcagagcttgtggtggtgggcaccatggcacataagagggcttctagttctttcaatcccaagcttttatgaggcccctgcagtgccccacccctcctttcctctcctctctcagctttcttcctctttcctgtgtattcggcaacctccaactccatggctcccccatccactgctatcatcccctgccctcgtgttctgggtactgctgggtcctaagtggcctgaatccaaggccccatcctggaggaactcctaagtctgagaaggtgaagctggacaaagacatctccaatttcacgggggtcagaaatggagctaagggagatgggctctgagaaccagaggagaataaggtctctgtgggggcaggctggaaggctttttggaggaacggttgctggagcagggcctggaatgatgactaggaattgttaaatcagaaggcagggtgattccacgggcatcattagtgtcccaggccccctgccaggactaacattggcatttccagtccccacacccagaacagtagaaggacttgtggctgctggaggatctgggttgctgtttacatagcatccaggtctggtgggtcagtttcttctacccctacctgtgaaccttggtctcctgccacaggcaccaggaatctttaataggagaccccttcccagcctgctacacttccctgggagctagggactgtacagccacaccgggcccagcgcagggcctgttgggaaggcactggcctccagggtatgaccccggcctcctatttagcaacactgcttttttcctccggcctgcctcaatgtcccagtgaaagcctgcaagcctggcgtcctgtccctgtcacccggggaggcttcttgccactttggggtgctccccatgggcgagacacgcaccctggggtggcagccagggactccatggcccccccgggtctggcccaaggcctgctgggaaggcactggcccccgggggaggacagcagcctctgcttcgctttgctgcctttttaccttggcctccctcaatgtccccctgaaagcctgcaagactggcatcctgtttccgtcacatgggggaacttcttgtcgctttgggatgcccccacatcggagtgacatgcaccctggggtgaaagcaaaagactccacggcgccccgccctcaggtctggcgcatggcgtgcaaggaaggcagtggtgtccggggtaggaccccagcctcctatttggtctcgccgctctttttttccatgtcctgcctcaacgtcctcctgaaagcctgcaagcctgatgtcctgtccctgtcacccagggggaatccttgctctttgggatacccccatggcagagacacgcaccctggggtgggaaccaaggactccatggccaccccgggtccagcgcagggcctgccgggaaggcactggcctccgggggaagaccccagcctcttcgaactcgctgcttttttcccctggcctgcctttatgtccccctgcaagcctggcgtactgaccccatcacccggggggacttattgcctctttggggtgctctccacgcacccttgggtgggaactagagactccatggccttctctgatcccgcgcagggcgtgccaggaaggcactggcctctggaggatgaccccagcctcctcttcagcctcacccctttttttccctggcctgcctcaacgttcccctgaaagcctgcaagcctggcatcctgtccccatcacctgcggggaagcattggggtgttccccacctaccgtggggtgggagccagggacttcacagctcccccacccccctgtctggcgcagcacctgctgggaaggcaatggcctgcgggggaggaatccagcctcctattccgcctcgccgcttttttttcccagccggcctcaatgtccctctgaaagtctgcaaacttggcgtcctgtccccatcacccggggggactccttgctgctttggggtgcaccccacccaccctgatgtgggagacagggactccacggcccccctgggcccggcgcagggcctgccgggaaggcactggcctccgggagaggaccccagcctccttttcggccttgcaggttttttgccctggcctgcctcagtgtccaactgaaagactggcgtcctctccccgtcacacgaggggcttcttaccactttggggtgccccccacgcaccctggcatggaagccagggactccacgaccccccgggtccgacgcagggcttgcggggaaggccctggcctccggggatggactccagcctcctcctcagattcgcttctttttttccccgccctgcctcaacgtttccctgaaagcctgcaagcctggcgtcgtgcaatgtcacccgggaggacttcttgccactttcgggtaccacctgtgggaaaaacaggtaccctggggtggaagccagggcctctacacaccactctgccaagatctggcgcagggcctgacgggaaggcactggcctccgagggaccaccccagcctcctcttcggcctctccgccttttttccccagcctgcctcaatgtccttctgaaagcatgtaagcctggcatcctgtctccgtcacccggggcgacttcatgccgttttggggtgccccccacgcaccctggggtgggagccagggactccattgcttccagggtctgccaggaaggctctggcctttgggggaggaccccagcttcctcttcagcctcgtcgattttttcctcggcctgcctcaacgttcccctgaaagcctgcaagactggcgtcctgcccccatcactcggagaaatttcttgctgctttgggtgcccccccgtaggagagacacccaccctggtgtgggtgccagggagtccacggccccccacgggtccagcgcagaatctgatgggaaggcactggccttcaggagacgacctcagcctcctcttcggcctcgctactttttatccatggcttgcctcaacgtccccctgaaagcctgcaagcctggcgtcctgtccccgtcacccagggggatttcttgccgctttggggtgctcccgtgggagagatgtgcaccctaggatgggagccaggaacaccacaacccccgccccggtgaacagggcaggactagccgggacggcactggcctctgggggggacgatcccagcctcctcttcagcctcgccactttttttttctggcctgcctcaacgtccctctgcaagcctgcaagactgacctcctgttgctgtcacctggggggacttcttgtcattttggggtgcccctcacacaccctgagatgggagccagggattccacgtcccccttcccccacccggtccggcgcagggcctgttgaaaaggcactagcttccaggggaggaccccagcctcctctatggcctcgctgcttttttttctcggtcggcctcaatgtccccctgaaaacctgcaagcctggcatcctgtccccgtcacaccgggagactttttgccgctttggggtgcccacaacccaccctggcgtcggagccagggactccacattccccccacgagtctggcgcagggcctaccaggaaggcactggcatccaggggaggaccgcagcctcctctttggtggcgccactatttttccgcggcctgtgtcaacgttttcttgaaagcctgcgagcctggagtccagtccccctcacttgggggtaattcttgccgccaaggggtgccccgcttgggagagacacgcaccctggggtgggagccggaaactccaccgattcccgggtccgacgcagggcctgccaggaaggcactggcctccaagggatgatcccagcctcctcttcggcctgccttaacgtccccctgaaagcctgcaagcctggtgttctgtccctgtcacacgaggggacttcttgccgctctgcggtgccccccaggcaccctggggtggaagctaaggactccaatgtaccccaggatccggcgtagggcctaccaggaaggaagtggcctccgtggaaagaccctagcctcctcttcagattcgctgcttttttcccccggcctgcctcaacgtttccctgaaagcctgcaaggctgacatcctgccccatcactctgggggacttcttgctgctttggggtgcaacgtgtggcaaagacaggtaccctggtatgggagccaaggactccgcagcaaccccagatctagtgcagttcctgctgggaaggcactggcctccgggggcaccccagccacctcttcagcctcactgcttttctttcccggcctgcctcaacgtccccctgcaagcctgaaagcctggcgtcctgtccccattacctggggggatcttctttccactttggttgccccacacacaccctgggtgggagccagggactccacggctcccccgggtatggcacagcgcctgctgggaaggaagttacatccacgaccctagtctcgtcatccgtctcactgcttttttccccaggtctgcctcaacttccctctgaaagcctgcaagcttgatgtcctgtacccgtcacccggggagacttcttgcccattttgggtgccccccatgcagcctgaggtgggagtgagggactccacggctcctcagggtccacgcagggcctgctgggaaggcactggcctctaggggacggccccagcctcctctttggcctcaccactttctttctccggtctgcctcagtgtccctctgaaagcctgcaagtctggcctcttatccccgtcacccggtgacactttgtgccgcttttgggtgcccaccacggaccgcggggtcagagcgaggaactccaaggctccccagagaccggcgcagggccagctgggaaggcactggcttccggtgagcgacctcagcttccattttggcatcgccgcttttttccccaggcctgcctcaacgtccccctgaaagccggcaagcctggggtcccgtccccgtcattcgggaagacttcttgccactttggggtgcactttacgcaccctggggtgaaagccagaaactccacggccttcccaagtctggggcagggcctgctgggaaggcactggcctctagggaaagactccagcctcctcttcggcttctccactttttttctcctgcctgcctcaacgtttccttgaaatcatacaagcctagtgtcctgccccgtcaccgggggggacttcttgccgccttggggtaccacccgtgggaaagacacgtatgctggagtgggagccagggcccccatggcccccatgaatctgccgcagggcctgccacgaaggcactggcccctggaggacaaccccagcctcctctttggcctcgcagtttttcttccccggcctgcctcaacatccttctgaaagcctgtaagcttggtgtcctgtccccatcatccaggaagatttcttgccgcttttgggtgccccccacccacactggggtgggagcgagggactccacgactccccagggaatggcacggggcctgccaggaaagcactggcctccgggggacaatcccagcttcctcttctgcctcgtcgcttttttccctcggcttgcctcagcgtccccctggaagcctggcgtcctgtatttgtcaccctatgggacttctagctgctttggggtaccctcgtgggagagactagcactcaggagtgggagccaaggaatccacagccccccaccccccgttaaggtgcagggcgtgccgaaaaggcactggcctccgggggaggactccagcctcctctttggccttgccgctttaattccctagcctgcctcaacgtccccctgaaaggttgcaaggctggcgtcctgtcccggtcaggcggggggagttcttcccgcttttgggtgggccccacacaccctgaggtaaaagccagaaactctacagccccccagggtcccgcacagggcctggcaataaggcactggcctccgagggaggaccccaacctcctctttggccttgccccttgttttccctggcccgtctcaatgcttccctgaaagcttgcaagcctggagtcctgtccccatcacccagggggacttcttgccactttgggttgccttccacgcaccctggggtgggagccagggactccacgcacccccccgcccccagtccagcacaggtcctaccaggaaggcactggcatccaggggaggaccccagcctcctcttcagtctcgccactatttttccgaggcctgcctcaatgttttcctgcaagcctgcaagcctggcgtcctgtccccatcactcagggggaattcttgccgccgaggggtgccccacgcagcacagacacgcatcctggggtggaagccggaaacgccaccaattcccgggtgcggcgcagggcctgctgggaaggcactggcctacgggagatgaacccagcctcctctttggcctcgctactttgtttcccggcctgccttaacgtccccttgaaagcctgcaagcctggcatcctgtccccttcacccgggggtatttcttgcctctctggggtgccccccacgcactctgaggtggaagccagggactccacggtaccacagggactggcgcagggcctgccaggaaggaactggcctccagggaaagatcccagcctcctcttcggagtcactgcttttcccccccagcctgcctcaacctttccctgaaagcctgcaagtttgacgtcctgccccatcacccagagggacttcttgccgctttggggtgcaacctgtcggaaagacacgtaaccccggtgtaggagccaaggactccaagctccccgctcccttcggatccagtgcagttcctgccaggaaggcattggcctctggggaaggaccccagcctcctcttctgcctgcctgctttttttttcttggtctgcctcagcgatcccctgaaagcctgcaagcctggcgtcctgtccctgtctctcgaagggacttcttgccgccttgtggtgcccacgaggcgccctgggttgaaagccagcaactccacagcaccccgggttcaggcgcagggcctgctgggaaggcactggcttccgcgggacgaccccagccttctctttggcctcaccgctttttttccccaccctgccttgttgtgaccaagtgagttatagagaaacgccacattttgagacaaattaaagagtcctttaatagccggcgaccgagaggcagctaactttcaaaattctcttggccccgaggaaggtgctagttttgtttttataccgtggtctaaataggggatggggaattttagctgaagcaatttttacaggagaactggcaaaaagttaaaaaattaattggttacaaatgcagttacaaaaaataaacagttccaggtgcagaggcttaaactaccacaaagagataaatgcaggggttttgggtgccatccaccgagcgcatccccaggagctgctggtgcagcttgcctcaatatcttatcagtagatgcattcctggatgtgctttgagtcagttttacactagttatgccttaagggagggcggtgaaagggggttgcaaatgaagaaactgaaacggaatctgttcggctctctctctgctaggagagagtcactcagttaaaaaaaaggtagggtatcacattccccactcatgttttggggaatcaaatcattgattcttcagttataccaagggggttatactcggttctgagatacataagtttgacagaagctatgcactgttttacaaagttaaggaaccaatttaacatacaagtcctgaagattaaacttaacaagaggaggagaaggggtcctgccagtacagtaatcagaatagttagccatggattccagttgaacatgctttgataccagggggtgttactttctcgttcttgttggagtctatctatattttctcgaactctttggagggtatcttttatgactccagactgattggcatagaaaaagcaacactctcctagggctgcacataattctccttgggaaggaaatagtagatctaagccttggtggtttttgaagaactacttcagctagagactctacctgggtatgtaacatatttatggctgactagagattgcttaaatcagcatctacttgctgagacagggacattaatccagtttctccctgaactagggcagccatgccaatgcctgctgacccagctatgctaaggctagctaggaggggtactaagagtggggcagcttggcgaaacttggaaggcaattcagggggagcaataagaagttctccttctggcccactgtacacatagacctggcggagtacatgaactaacacacacagaagaggtccatgttcagtcccattgatgcagtgagtgaggcctgaagtacaagccaaccaggtgttgttaggtgcctggtaggaaactgaggtgtttaaggaagtaagtagcgattgattacaggtggcctgaaagggagaagcagataagttatacccattgctaattagacaggaggcattcccctacatgtctcctaatgtaagggcatggggtcgtgtatgacaaaagagagagttaaccttgaacatggcctctactcctaaaccaacattatatggggattttgctgtcaggcacaaccaacaatcttgggctagttttggctgggtgaggttaaggaggtgatgcactccatccagaatggacatcaggccgggttggagatgctgtcgttgtaattgggatttaggaaccaagagtggtgggacagttaaatcgaccctgtctgggtgtttttggaacatagggtcacctaaatcagttagaggtccgattggcttaggagggctccacgggaccaggacatttttctgaatggtgaacatagttccaacatcaaatcctgagatataaagtcttaatccccattacatgccataataccattgagctgaattagggttacggacagttataggaagagggttgcagttccttagagtgcacggtctaggacaggaagagcgagttatggagagggttgaggactgggttgatcctccagagtaagtggccagggttacacacaagcagttagggcagaaaaactgataggaatctcaacaactgggtcagggtgatttccagtacaggggtaaaaatcaacgctctggagtcctttttctgcacctttagagctccctcatccagtccggcttcctgtgtgtccgaatcctgcagccaggtcaatgtttcctgctcctatgaccagcagattgcattgcttttcatgggtatgggcaggctctgggaataagcacataaatcaactgcaaaagagacttttttggagcttcctgccttccaagtagtgtttgcaaatacacgtcctgtcatgaaagaagtaaggagaaaagagtaggatggagcagaaggcatgacaggcgggaacacacaaaagaggtaaataaaaggaattaatttgatggcttcaagtgacttaggtgcagttttaaggggcctggcccaggcttggggatccatgtttcttgctgggctttgctagcctttttgatgagagagtgatgaatccaggcaggaatgccatccacctttagagctgtcagcgtggtgaggatgacagtatgagtcctttccaggcaggaatgaatccttctttctggaactttttatcgtacaccaggtcacccggctggaaagagtggcagggtcccatctggtcaggaactggatttgggcgtgctccctggacaagtgcctggatgatgtctcgtacctgttggagagactgcatgtactgtaataagttagcttgagagatttctgctaaatgagtgtctctcaacctaggcaggataggtggagcccttccatacataatttcaaaaggtataaacccagctcagtaaggggtgcatgttactctaagaagggctaaacgaaggattctcacccaattctcacccatttctagaatcaattttgtaagagtattttttagggtgtggttcatgcgttctatctatccagagctctggggtcggtaggcacaatggagtttccatttgatgtttaatgccttgctgaccaactgatgtatggactaggtgaaggctggcccattatcagaccctatggcaacaggcaacccatgtcttgggatgatttcatttagtaaaaacttaactaccctagtggcagttttgtttctggtggcaaatgcctcagtccacccacaaaagatgtctactagcaccaggaggttcttataccctgcccagtgtggtttaatttctgtaaagtcaatttcccacctttctcctggtgagtctctgcagagatggtggcctgggctgggtttgggaccttgcttggcatttacctgagcacaagccatacactggagagctgcttggttagctaagtcctgagggtgggggatcttgaaacagctccttagaagctgggccaattttactcctcccaaatgggtggtagaatgtagacgattgactagagttttcccaagggcttggggtctgaagattctggaatcaggaataatccaccaaccttcctgatttttattagcctaaagatctgaagcctgtttgtcttcttctgtggagtattttgggtgatttggcaagtcaggctgcagaaaagacatggcgggcagtaggaccaagggcacgactgagagctgaacagcttctcggggctgcagagtctgctttggttaccacgggcaatggctgtgttttctctttgatgtcctttgcagtgaattacagccacctgctgaggaagccaaacagcttcaagaaaggctaaaatttcttctttgtttttaatagactttcctgctgaggtgagtagcccatgctcttgacagatggctccatgtacatgtacagtagcaaaagcatatctgctgtcagtgttaatgttaatacatttgtccttaccccatgggagagcctgagtgagggccatcagttcagccttctgggctgaagtatttgctggcaatgcctgggcccatagcacatccaactccatggtaatggccgcaccagccttctgtactccttgttcaaggacgctgctatcgtctgtaaataaggtgacctccactttctttaggggcacatcttggagatcaggtcggccagttttggtagtttctaacagttcctggcagtcatggacaggtgtagtgaactctggatcaggaagtaaagtagctggatttaaacaccttgtgggagagaagtcaaatgaggctgatctaacagtaaactctgatactgtaggatacgagcatttgacatccatttgctagaagcactttgtagcaaagtctctacagcatgtggagctgtaagggttaaattttggcctagagtcaatttgtcagcctcttggactaggcttgctgttgctgccatgactcacagacagcttggccatccagaggccatagggtccagtctctcagacaaataggctactgggcgtctccagggtcctaaagtctgagtgagcgcccccttagcaactccctggctttcatgaataaaaaggtgaaatggttttgagatatcagggagggctagagcgggggcctcagttagtgcctttttcaggtttttgaaagcctgttcttcagtgtcagtccaaactagtgggccattccttccagtagtggtgtacaggactttggcaatttctgcaaaccctaatatctacaggcgacagtatcccacagcccccaggaattcacgtacctgtcttttggtggtgggagtggggattcgcagaatggcttccttataagcactggtgagtgcccattttcctttatctcataccctaggtaggagactctgtgaagacaaagctgggcctttttggctgagactcgaaacccgagttcctgaaggaggtaaagtaagtctctagtatgttgcaggcagctgtcagaggtttcagtagctaataaaaggtcatctatgtactgaagaagggtacaattagggtgtctggctcaaaatggtacaagatcctgttggatggcttccccaaaaagggtgggggaatttttaaaaccttgaggtaaccgagtccatgtcaattgggtggtgtctccttagccaggatctgtccattcaaaggaaaatataggttggcttttgagggccagaggaatagcaaagaaatcatcttttaagtcaaggacagtgtacactgtgtgttctggtgggagcaggctgagtaaagtataagggttagggactgtagggtggacagtgactgtccatctgttaacttcctttaaatcctgtacaggctggtagtcatttgttccgggtttttggaccagcaacaatggagtgttccaggtggactgacatggtgtaagtatgccagcctgtaacagttgctgaatatgggggttgattccttccctagcccattgactcataggatatgctttacctggactggcaaggcagtggccaggagttctactaccactggcggatggtgcttagccagtcccaggaggtttgactcagcccagacctgaggaaagagagtctgtaagcccagtaagagaggattagttttattctccagtggttgtgaaggtgaaactaagagatattcttctgacagaggggtggttagcaggagctgagcagtgggaggtgttgtgtctcttagcatgaggtgagcttgttgggctgagatggaaatagatgcctgcagcttgtggagcatgtctcttcctaggaggggaaagggacactctgtgaccatgaggaatgagtgggttactcttttctgtcctaaactcacctcttgtgagtgggtgacaggatattcttgaatcactccagtagccccttgtacagcaactttcttattagagacactgcctagcggaatctgcaataccaagtgttccaccccagtgtcaattaggaagtgtacaggctggccccctactgtggcggtcaccatgggctcccaggggccaagtggaaaggagccctggccccgtcactcatgagattcctccacaaaagggagggtgaggacttttttctcttctggtttttcctctggtcttaacgggcattcctttttccagtgtcccatctgcttgcaataagcgcattggtttttctccaggggagcccggtcccctttctggcttttttggtggggacctggggttccctgaccatttttctgtgacaggggcttttctttcttgacttcatgaatggcagccactatgatttttgcctgtctttttgatgctttgtcagcaggcttttcagctgcctgagctgcctgtttctgcttttcaaactctcagttgtcaaaaaccttttgggctatctctaaaagctgactgatgttcattccagcaaatccctctagcttttgcaattttcttttaatgtcaggggctgcctgagccacaaatgccaaattaagagcacagctattttcgggagccattgggtcaaaaggggtgtaagtctgataggcctcctggaggctttcctaaaatgctcctggtgacttgtcaggcccctggacaacttcagttgtcttagacaaatttatgggtttttgagtggctcctttgacacccacaaggagataccggtgaaaatcgtctaaggctctccttccacctgaggaatttgggtcctaattaggctgggtagagggaaaagcctcttcaatttggtctcaggcttcctcttctggcccaccagctgatgtaaggtaatactttctggcctcccttcccatacactccctctcttcagaggtgaaaagggttaaaagtagttgctgacagtcctcccaggtgcggcagtgagtctggagcacggactccattagtgaggtcaaaacctgtggcttttcagaaaaagggggattatgaggcttccagttgtacaggtcagaggtagaaaaagggacaaactaagaagggagctgagtgctctctcccaaatattttgggtctctctcagtgggaggaggggggctacctcctcctgccttggccacaatcgggaagctatgggtggagagcccacaggagatgtagtcgaggaaacaagggaagaatccgggggagaaggagggttatagggtggcagaactgggagaggaaaactttcctcttcctcagaagaaggcagtacaggaggagccgaggggactcagggtcagggtaaaaatgtggaccggctcaaaaggaccctggaaatgggatcatgaatggcacatgagtggagccagggaggagggccccgtaccaaatccagccactgatcaatgtagggaaactgattggggtgaccgggacttccagtaatgacctgccacacatcctgaacacatgtggggttaaatgacccttctgtgggccatctggttccaaactgtggccattctacttcacagagtgtccagagtttgcctttcttcaggcagactccataatcttctgagaagtctacagagaaattctgcagtatacattggagaggactctactctttacagggccaggaagaggagtttcctattttggaggcagtttaacaaggttgaacagagatattaaacccagcatggacagagaaattcacaacctgggggactggcatattggaagaagggaaataacacaaccagaaagagcaggaaaaccactacagctaagacttcctgccatatgaagtaggttttcttaagcttcaagatttaggggggaagattagcaaccaacccgaggcctccttggctggcaggacctagatgacctccttccttcccttgacatatagcccaggtatttttggtgtctccatgattcaaagacaaaaagttcaaactcggccctttctttcaagggttttaggagggagagcagggctaaatcttggaggctctggacttgctgtgacacaggaaaatgagatgtgtggggaagggataaggatgagggggaaagggcccacttggatctctcctaaggtaggagagtagccaccggggaacagaataggagtccagatggagtaaagcagtatgagcgtaggcttctctgcacagtcttctattcaaaggcacgggaaacgttacaggatgacagaaaaggtgggcaaggaggcctgcagggtgactattttggatccaccactgatctaatcgggaggctgtccagtcactagagtgtgggatgtggcaatctaaattccagcagactttatggtgccagaaattccaaatgggcgagtgtttcccacacttcttcccgtaacaacacttgatttctttctgacagaaaaggcaggactgggacggccagcccaaatgactgatgaggtatttgacctcctgtggtagaaaatcagcactgaggaccttgaagaatttctttcctagttgccttggacagcactggcgacctgactatgaaacttagactgacactaaacaagacaatagacaccgagcaggacaataaacataaaacaaacaacagaccctagggtataagaacaattatggcagtttttattaaatagacaaggggagggggtccggtgatgggatcagtcagatgcccgcctggccactctccctgaggggacttgggctcctcttagcattggcaggctggtataaacccccggctcggatcgagctatgctcagtgctgccttaagccttatgaggtcaccatggaactacaggtgcgggcccactcgaactccatagcttttgccgtggagctacaaactggaagttcaagtgcaagcccttgacttccccatccactcaccattcacacaaagtttataatagtttttttttttttgccataaaacagaagtcttatggaaacctgaacgtgaaagggaggagagatagagaaagagagagcagagagagagacagagagagagagagagagactagtctttaatggagaggccagcctgccagaaaccaggactcagtcctccagcatcctggaatatggattgagtcaagggagggcccccgtcagggccgcttccctcccagagagacacagaggcacctaacagaaaatcaggactctgtcctccagtgtgctggaatgcgggcagagtcaaagagggagggccctgtcagagccatttccctcccagagaaacagagtcagatatgacttaccttcccgggaccagaggactcaggagttgaatttttctgggcacacaccagtggtcgatccattcccctccagaagacagggtcttatggggccctggaacgtcttcagggggcgcctcccctataagtccactgtctgtctgggggaacctggaatgagtccggctcttgcccagtggcgaatatctcactggggcctccaaatgttgtgaccaagcgagttatagagaaacgccacactttgagacaaattagagtcctttattagccagtgaccaagaggcagctaacgctcaaaattctcttggccctgaggaaggggctagttttgtttttatactgtggtctaaataggggaggggggattttagctgaagcaattttttacagaagcagaactggcaaaaagttaaaaaattaattggttacaaatgcaattacaaaaaataaacagttccaggtgcaggggcttaaactatcacaaagagataaatgcaggggtcttgggtgccatccacccgagcgcatccccaggagctgctggtgcagcttgcctcaatatcttatcagtagacacattcctggacacactttgagtcagttttacactagttatgccttaagggagggaggtgaaagggggttgcaagtgaagaaactaaaatggagtctgttcggctctctctctgctaggagagtgccactcagtttaaaacaaggtagggtatcacagcctcaacgtccccctgaaagcctgaaagcctggcatcctgccccatcactcggaggggggaacttcttgctgcatggagtgccccccaagcaccctggtgtgcgagccaggtactccacggccctccagggtctggtgcagggcttactgggaaggcactggcatcctgggaaggaccccaacctcctcttctgtctagctgctttttatccttggcctgcctcaatgttcccctgaaagcctgcaggcctatcgtcctgtaactatcaccttgtgggacttcgtgccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagcctgcaaggcttgcgtcttgtccccgtcaccaggggtgacttcttgtcactttggggtgcccgccacgcaccttggggtgggagctattcactacacggcacccctgggtccactgcagggcctgccagaaaggcactggtttccgacggaggacccaaccctcctcttcagattcgctgcgtttttttcccgacctgcctcaacatccccttgaaagcctgcaagcctggtgtcctgacccatcaatccggggaaatttcttgccgcttttgggtaccacccataggaaagacacataccctggcatggaagccagggactccatggccccccggatctggcccaggacctgccgggaaggcactggcctccaggagatgactccagcctcctttttgccctcgacgcttttttttctctggcctccctaacgttcccctgaaagcctacgagcctggcatcctgcccctgtcacccagggggacttcttgacgctttggggtgctcctcatgcacgccggtttgggagccagaaactccacggccaacccctgttccagtgcagggcctgctggagtcactggcctcatcgggacggcaccagcctcctttcctgccttgctgctttttttccctggcttgcctcaatgtccttatgaaagcctgcaagcctggcgtcctgtccttgtcacatgcagggaattattgccactttggggtgccccccacccaccctggggtaggatccagggactccacggccctcccgggtttggcgcagggtccaccgggaaggtgctggcctccagtggacaaccccaggctcctattcggccttgccactttttttcccctgcctgcctcaacgtccccctgaaagcctgcaagactcgcgtcctctccctgtcacccgggggaatttttgtctctttgggggtgcccataatgcaccctggggtcagagccaggaactccacggccccctcaggtccagcacagggcctgttgggaaggcactggcctcccttggtcgaccccagcctcctcttccgcctcgctgcttttattcccccgcctgcctcaccgtccccctgaaagtctgcaatctggcctcctgtccctgtaacagggggtgacttcttgcctctttgggttgcctcccacgcaccctggggtggaagccagggactccacggccttcctgagtctggtgcagggcctgctggaaaggcactggcctctgaggggggaccccagcctcctctttggcctcgcctcttttcttctctggcctgcctcaacgtccccctgaaagcgtgcaagcctggcttcctgtccgcatcactcgggtggacttcttgctgctttttgttgcccccactacgtatcttggggtgggagccagggaccccacgaatcccccaagtctggcacagcatgcccagaaggcaatgtcctccgggggaagagcccagcctcctcttcggcctcactgcttttttatccaggcctgtctcaacgtccctctgaaagcctgcaagcttggcgtcctgtccttgtcatccgttgaggcattttgccggttttgggtgcccctcacacaccctcaggaggaagccagggacttcccggcttcccagggaccaatgcagggcctccctggacggcactggcctcagggggaaaactccaacctcctcttcggggcctcgccgctttttatccctggactgcctcaatgtccgcctgaaagcctgcaagcctggcgtcttgtctgtcacccggggagacttcttgccgctttggggtgcccccggtgagggagacgcacactggggtgaaagccagggactccacggcccgccatgttctgtcgcacagactgccaagaaggcacacacctccgggggaaaaccccagcctccttttcagcctccgctttttctccccagcccgcctcaacgtcccccgaaagtctgcaagcttggggtcctgtccccatcacccagggggacttcttgctgctttgggttgcctcccacgcaccctgggttgggagccaaataatcaacagcactcgcgtgtctggtgcaaggcctgccaggaaggcactggcctcaggggagaaccccagcttcctcttcagccttgccgcttttttcctggcctgcctcaacgtccccctgaaagcctgtaaacctggcatcctgtcactgtcacctggggaaactttgccgctttggggtgcccaacgtgcacccgtggagccagggactccacggcccctccgcctctggcgcagggcctgttgggagggcactggcttccggggaccacatcctcctcttcggtctcaccacttttttcccctggcctgcctcaacgtcccccctgaaagcctgcaagcctggcgtcctgtctccttcatacagggggacttcttgctgctttgtaatgccccccacgcaccctggggtgggagccagggactccttgccaactttattctccggcctgaatcaacggcccacagaaagcctgcaagcccggcgtcctgtccctgttacccgggtggacttcttgctgctttgaggtgcaccctgtggaacagacacacaccttggggtaggaaccagggaattcacacaccccccaccccctccctgggtccggcacaggttgagttgaacagcctgcggaaaaggtactggcctctgggagaggacccccaacctcctctttggcatcaccactttttttccatggcctgcctcaatgtccctttgaaaggctgcaagcttggcgttctgtcatcacgcagggggacttcttgctgttttggggtgcccccatgcaccatggcgtgagaatcagggactccacggccaccccgggtctggggcaggacctgttgaaaaggcactggcctccagggaaggaccccagcctcctcttcagccttgccacttttttttccctggcctgcctcagcgtccccctgaaaccctgcaaggctagcatcctgtaccagtcacatagcgaaaattcttgccgctttgggatgttcccccaaaccctgaggtgggaggcagggactccacggtcctccctggtctggtgcagttcctaatgggaaggcactggcttccggaggatgactcctgcctcctcttgggccttgctgctttttctccccagcctgcctcaatattcccctgaaagttcgcaagcctggcttcctgtccctgtcacccacagggacttcttgccactttggggtgcccccaggggagagacatgcaccctggggtgggagccaggaactccatggccccctgggtccaaagcagggcctaccatacaggcactggcctccaggggaggaccccagcctcctctttgttctcaccacttttttccccatcctgcctcaatgtccctgtgttggggaaaggctgagtgttgggaaaaaaactgaggcagggcttgcatgtgtgacataatgtaaaagggtcttggaacatgtccggggtccagggtctaaaaccccttatggcctttggaacaccaagctctgtgccaaagggtggaaggctgccctgccacaccataatctaagccctgggcatgaaaccactcgtggcttgcatagaatccaggacttagggcataaaacccctcctggcttctagaatgtgtctagacttgctggctccttgcttctagcactgctattatctcaagcagcagaacttgttccatatgcttcaaagaaaatactaaatcatcacagctgtagatcatgtgcaacccccctacatcctcgccacctgtttctttgtttgatcaccaatgaatagggtgggatcccagagctaggggccttcacatcctccatgctagcattggccccctgatcccactttatgcctttacttgtcttttctcattcctttgatttggccggacctcattgcccccacagctgggtgttgggtttgatcacctcaacagccctgaaagcctgcaagcattgcaacctgttcttgtcatccagggagacatcctgccacttaggggtactgcccatgcaccctatgatgagagcaagaaactccacggcatccctgggtccagcacagtgcctgccaggaagacactggccactggagaggatcccagcctcttccgccttgtcactttttctccccagcctgcctcaacatccccctgaaaccctgcaagcctggcgtcctgtccccgtcacctggcaggacatcttgctgctttgtggtgcccccaatgcatgctggtgtgggagccggagactccaaatctcccctgaggcactggcctctggggcaggaccccatcctcctcttctgcctcaccactttttttcctctgcttgcctcaacatccccctgaaagcctgcaagcctggcgtcttgtccccgtcacctgggggcacttcttgctgctttgttgtgccccctgtgggaaagacatcaaccctggtgtgaaagccatgggctccatggccccccagttctggtgcagggcctgataggaaggcactaaccttagggggatgactccagcctcctcttcagcctcgccactttctttccctggcctgcttcaaccctggtgtgaaagcctaccggaaaagcactggcttcagggtggggggaccccagcctcctctttggcctcacctctttttttccccagactgcctcaatgacctcctgaaaacctaaaagcctggcgtcctgtccccatcacccggggggcacttcttgccgctttggggtgccccccactcaccctggggtgggagccagggactcctctgcccgccccccctgttcagatgcaaggcatgctgaaaaggcacttgcctttgggggaggaccctagtctcctctttggccttgccgcttttttcccttggcctgcctcaaagtccccctgaaagcctgcaagcctagcgtcctgtcccgtcacctgggggaaattattgcccctttggggtgccacacgcaccctggggtggaagccagggaccccgtgccccccccccgggtcggggcaggccctgccaaaagaaccccggactcagagggaggatcccagcctcctcttcagccttgctgcatttttttttccggcctgcctcaaggttcccctgaaagcctggccgcctgtccctatctcctggggtacttcttgcctccttgtgctgcccccgtggggagaggaacatgcccttgttgggagccagggtctccacaactcccacgggtagggcataggaactgccgggaaggcactgacctcctgcgagggacccctccctcctcgtcagcctcgccgatttcttcccatgcctgccgcaacctccccctgaaggcctggcctcctctccttccacgggggacttcttaccactttggggtactccaggaggaaagacacgcaccctgtgtgggagccaacaactccacgaagcccctgggttaggcacgaaggctgtcgggaaggctttgacctctgatgggggatcctgacatcctccttggcctcgctgcttttttcctgggccttcctcaacctccccataaatgcctggctgcctgtccctgtatcccgggggacttcttgctgctttggtgtgcccccgggggaagagacacgcaccctggttggcagccagggacttcacgacccccctcccccaggtccggtgcgggggctgccgggaaggcactgacctctggcgggggaccccggcctcctattcaacgtcgatgttttcttcccgggtctgcctcaacctccccctgaaggcctggacgcctgtccccatcccccggggtacttcttgccactttggggtgccacaggaggggagactcgcaccctgggtggtagcctgtggcttcacgaacctccctcatgttggtcgcgggggctgccgggaaggcaatgacctccagtgggaaaccacgacctcctttttggcctccctgctttcttcccaggtctgcctcaacctcccccgaaggcctggccacctgttccattgccctgggggacttcttgccgctttggggtccccatggggggacctctgcactgacccctggcaggggaccctggcctcctcttcggccttgccgctttctttccaggcctgcctctacatcctcctgaaggcctggctgactgtccccctccccctggggtcttcttgctgctttgggttgcccccagagagaaaacatgcaccttgggtgggagccagagactccatgaaccccttggttgggcacggagactgtcgggatgggactgaccccaggcaggggacacaggcctcctcttcgacctggctgcttttctcccaggcctgcgtcaacctaaccctgaacgtctggccgcctgtcctcgacactgggggacttcttggcgctttggggtgcccccggggaaagaaacatgcaccctggttgggatccagggactccacaaccacccctcatcaggctcagggactgccgggaaggcactgacccctggtgggggacccaggcctcctctttggccttgccactttcttcccaggcctgcctcaacctcctcctaaaggcctggctgcctgtccccatccactgggggacttcttgatgctttggggtgccccaggaggggagacacccaccctgggtgggagccagggactccatgaaccccctggttcgggctggagggctgccagcaaggcatggacccccagcgtgggaccccagcctcttcttcagccttgccacttttttccctttcctgcctcaacttccccctgattccatataaccccgggttcaggcacggggtctgttgggaaggcacttacctctggccggggttcccggcctcttctttggcctcaccacttctttcaggactcccatgggttgggcactggggctactggaaaggccctgacccctggcgggggatcccggcctcctctttggcctctccgctttcttcctgggcctgcctcaatctccccctgaaggccgggcctcctgtccctgtccctctgggaacttcttgctgccttggggtgtccccgtatgggagagacgcaccctgggtggaagctagggactccatgaatgccccccggtcaggtgcggggactactgggaaggtactgacccctggcggggggcttcggcctcctctttggcctcgtgacttccttccccggcctgcctcaagcttcccctgaacacgtggccgcctgtccccgtctaccaggggagtttttgccagtttggggtgcccccgaaggggagagacatgcaccctggtggggaggaagcaactccatgactcccccgggttgggcgtggggactgccgggaagtcactgactgccggcaggggacctcggcctcctttttggccacattgctttcttcctgggcctgcctcaacctcccccggaaggcctggccacctgtacccatccccccagggacttcttgctgctttggcgtgcccccatggagagagacacacatacttgttggaagccatggactctacgacccccccagtttgggctgggggatgctgagaaggcactcacctctggtgggggaccctagcctcctctttggcctcgctgctttttttctaggcctgcctcaaactttcactgaaaccttggccgcctgtccccgtgccctgggggacttcttgcctctttggggtgccccaggaggagagacacacaccctgggtgggagccagggactccactacccacctgagtcaggtgtgggtgctgccaggaaggcactgacctccaatgggggacaccagcctcctcttcggcctagccacttttttctcatgcctgcctcaacctccccctggaggcctggccacctgtccttatcccccggggtacttcttgccacattacggtgcccacggaggggagacacacaccctagatgggagccagggactccacgaccccacggatcaggcatgggggctgcctagaaggcactgacttctgacgggggaccccggcctcctcttcagcatcgctgcttttttcctgggacacactcaactttcccctgaacgcctgtctgcctgtccccgtcttctgaaaatctttttgtcactttggggttcccccaggtggagagatacctaccctggttgggagccaggaactccacaacccactcgagtcaggcgcaaagtctgctggaaaggcactgaccttcgatgggggaccccggcctcctcttcggcctcactgcttttatccccggcctgcctcaacctccccctgaatgcctggccacctttccccatccccagggggagttcttgccactttggggtgcccctgggtggagagacatgcaccctggttgacagccagaaactccacgatcccccaggttttggcttggggactgctgggaaggcactgactttaggtgagaaatcctggcctcctctttggccttgctgctttcttcccaggcctgcctcaacctcccctgaaggtctggcagcctgtgcccgtccccctggggacttttgccactttgggttgtccccggggggagagacacaaatcctggttggaagccagggactccacgacccctccaggttgggcgcgggggctgctgggaaggcattgacctgtggtgggggacctcggcctcctttttggcctgctgctttcttcccaggcctgcctcaacctccctgcgaaggcctcgccacctgtcctcatccccagggggacttattgccaatttgtggtgacccaggaggggagacacacaccctgggtgggagccagggtctctacaaaccccctgggttgggtgcagtgtttctgggaaggcattgacctgccatgtgggaccccggcctcctcttcggcttccctgcatttttcccgagccttcctcaacctccccctgaaagcctggctccttgtctccttcttccagggaacttcttgccactttggtgggcccatggtgggagagatatgcaccctggttgggagccagggactccacgatcctcccacgttgagcatggggactaccgggaaggtccagacctccggcgggggaaccaggcttcctctttggcctcgacgctttcttcctgggtctgccccaacctctccctgaaggcctggctgcctgtccccatcccctgggagacttcctgccacttttgggtaccccaggaggagagacacataccctggatgggagagaaggactccaagaaccccccatgttggccgcaggggctgccaggaaggcactgactcttagcaggggacctttgcctcctcttcggccttgctgctttcatcccaagcctgcctcaacctccccgtgaaggcctggttgcctgtccccttcccctggaagacttcttgcctctttgttatgcccccggagaggagacacgcacccagggtgggagccaggaactccacgacaccaccggtttgggcacaagggctgccgggcaggcactgaactctggcaggtgaccctggccttttctttggcttcactgcttttctcccaggactgcctcaacctcccccagaaagcctggccacctgtcaacgtctgttggggtacttcttgcactttgggatgacctcgtggggagagacatgcaccctggttgggagccaggaactcaacgaatcccatggattgggcacaggggctgccaagaagacccggacctctgggggtggaacccagccccttctttggcctctccactttcttcacagacctgcctcaatctaccctgaaggcctggcctcctgtccctgtcccccgggggacttcttgctaccttggggaaggcactgaccttcagcaggggatcccagccaccattttggctttgctgctttcttcatgcacctgcttcaccctctccctgaaggtctggccacctgtcccattcccccaggggacttcttgctgctttggggtgcccctgcagggcagacaagcaccctgggtgggaaccagggactccacgactcccctggtttgggaacaggtgctgcctggaagacactgatctctggcaggggaccccggcctcctctttggccttgccacctttttcccaggcctccctcaacctccccttgaactccagacaggctgtccccatcacactagggaattcttgcctcattggagtgcccccagtgggggagacatactccctggttggaagccagagactccacgacccccttgattctggcctgggggacacagggaaagcactgatctcagtggggggaccccggcctcattttcagcctcaccactattttcccaggtgttcttcaacctcccccttaaggcctggccacctgtccccgttccctgggggacttcttgcctctttgtgatgtgtgaattcatctcacacagttaaaactttctcttgattcagcaggttggaaaaactctttgtagaatctgagaaaagacatttgaaaaatcatcgatgcctatagtgaaaaaccaaatatccccagataaatactagaaagaagctatctgtgaaacagctttctgatgtgtttactcatttcacagagttaaacctttgttttgattcaggaggttgaaaacacttcttgtagaatttgtgaagggagagttgggagctcattgcggcctacagtgaaaaacagaatgtccccagatacaaactagatagaagctatctgtgaaactgctttgtgataggtggattcattgcacagagttaaaactgtcttttgattcagcaagttggaaactctctttttgtagaaactgcaaggaaacatttgggagcctattggggcctattgggaaataccaaatatccaccaataaaaactagaaagaagctatttgtgaaaccaccttgtgtgtgtggatttatctcacagagttcaacacttctgttgacagaaaagattggaaacactctttttgtagaatctgcgaagggacatttggaagctcattgaggcctatagttaaaaaaaaaaaaaaaggaatatccccagataaatattggaaagaagctatttgagaaacgtctttgtgatgtgtagaatcatctcacaaagttaaacctttctctttattcagcaggttggaaacactatttctgtatgcactatgaagggactcttgggagcccattgaggcctataatgaaaaactgaatatccccaatgtaaactagaaataagctatctgtgaaactgctttgtgatgtgtggattcatctcagagaactaaacctttcttttgattcagcaattgaaagtactcttttttagaaactgcagagggacatttggaagcctattgaggcctatagggaaaaactgaatttccctcaataaaaactagaaagaagctatttgtggaactgctttttgatgtctggattcatctcagagagttaaacctttcttttgattcagcatattggaaacaccttctctgtagaatctgctgtgggacatttgggagcccattgaggcctacagtgaaaaaagaatatacgcagatgaaaactagaaagaagctatctgtgaaactgcattgcgacgtgtggattcatctcacagaattaaacttttcttttgattcagaaggttggaaacattctttttgtagaaactgcaaaaagacatttgggagcccactcaggccttatagtgaataactgaatattcctcaataaaagctagaaagaagctatctgtgaaactgctttgtgatgtgtggattcatctcagagagttaaacatttcttttgattctgcaggttgggaacactctttttgaagaatctgtgaaggcacatttgggagtccattgaggcctatagtgaaaaactgaatatccacagataaaaacaagaaagaacctatctgtgaaatggttttgacatgtgtggatttatctcacagtgttaaacctttccattgattaaacagattggaaacactgtttttgtaagatctgtgaagttacatttgggagctcattgatgtttatagtaagaaaatttaacatctccaaataaaaattggaaacaaactacctgtgaaacgtctttgaaaggtgtggattcatctcacatagttaaactattcttttgattcagcaggttggaaacaatcttttttagaaactgcgaagggatatttgggggcccattaaggcctatagtgaatatcccctgataaaaattagaaagaagctatctgtgaaactgctttgtgatgtgtggattcatctaagacagtaaacctttcttttgattcagcagtttggaaacactctttttgtagaatcagcaaagggacattttggagctcattgaggcctatagtgaaaaactgaatatgcccagatagaaaccagatagtagctatctctggaactgctttgcaaaggatggatttatctcccagagttaaatttttcttttgattcagaagttggaaacactgtttttgtagaaactgcaaaggaacatttgggagcccattgaggtctagagtgaaaaactgaatatgtgcagataaaaactagaaagaagctacctttgaaaccaatttgtgatgcatggattcatctcacagagttaaaccttcttttgattcaacaggttggaaacactctttttgtagaatctgcaaagtgacatttgggagctctttgaggcctacagtgaaaaaccgaataatcccagatagaaagcagatagtagctatctctgaaactgctttgcaaagggtagatacatctaccagagttaaatctttctttttattcaggagttagaatcactctttttgtagaaactgtaaagggacatttgggagcccattgaggcctagattgaaaaactgaatatcctcgaataaaaactagaaagaagctacctttgaaagcaatttttgatgtacggattcatatcacagagataacctttctttcttttgtttcaggagtttgggaacattctttttgcagaaattacgaagggacatttgggagcccaatgaggcctagagtgaaaaactgaatatctacaaataaaaactacaaagaatgtatttgtgtaaccactttgcaatgtgtggattaatctcacagacctaaaattttcttttgattcaacaggtgaaaaactctctttttgtagaaaccgcgaagggacatttaagagcctattgaagcctatagtgaaaaactgaatatctgtggataaaaactggaaaaatgctatctgtgaatgcactttgtgatgtgtggattcatctgacagatttaaacttgtcttttgatttagcaggttggaaacactcttttagcagaatctgtgaatcgacacttggaatctgatagaggcctgtagtgaataactgaatatcccatgacaaaaattagaaagaagctatttgtgaaactgctttgtgatgtgtggattcatctcagagagttaaacctttcttttgattaaacaggttggaaagaaacactctttttgtagaatctgcaaagtgacatttgggagctcattgaggccaatagtgaaaaattgaataatctcagatacaaacctgaaaccaccttagaaaaagtggattcatctcctagatttaaatctttctttcgattcagaagttggaagcactctttttgtagaaaagtgcaaagggacttttgggagtccatggaggactatagtgaataactgattatccccagtaaaaaacaagtaagaagctatctgtgaagccaatttgcaatgtgtggattcacctcacagggtgaaaactttgttttgattcagcaggttggaaacactgtttttgtagaatccatgaaggaatatttgggagcccattgtggtctagagtgaaaaaccaaatatctgcaaataaaaaatagaaaaatcctgtctgtgaaactgctttgtgatgtgtggtttcatctcacagagttaaacctttctttgattcagtgggttttaaacagtttttttgtagaatctgcaaaggtatatttggaagcccattgaggcttatactgacaagctgaaaaaacccatgtaaaaactagaaagaaagtatctgtgaaactgctttgtgatgtgtggattcatctcacagagttaaacatttcttttgattcagcaggatgtaaacactatttgtagaaactatgaagggacatttgggagcccactgaggcttatagtgaaaaaccaaatatttgccaataaaaactagaaagaagctgtgtgacactgctttggtatgtgtgtagtcatctcacagacctaaaactttcttttgattccactggttaaaaccactctttttgtagaaactgcaaagagacatttaggagccctttgatttctataataaaaaacagaatattctctgataaaaacagaaagaagctattgtgaaactgctttgtgatctgtgtattaatctcagagtgtaaaaactttcttttgatttctcagtttggaaacacttttttttgtggaaactgcaaaaagacatttgggagatcattgaggcctgtagtgaaaaactgaatatccccagaaaatactagaaagaaactgtctttgaaactgctttgtgatatgtgtatttatctcagaaagttaaacctttcttttgattcctcaggttggaaacatcatttttgtagaatctgcaaagggatgtttgggagtccaatgagacctatagtgaaaaactaaatatccacagataaaaactagaaagaagctatcagtgaaagggctttgctatgtgtggattcatcttacagatttaagcctttcttttgattcaataggttggaaacactgtttttgtagaaactgtaaagggacatttgggaccccattgtggcttattgtgaaaacccatataccttccaataaaacctcaaaagaagctatctgtgaaactgctctgtgatatgtgtattcatctcatagagttaaatcttattttgattcagcaggttggaataactctttttttgtggaatctgcaaagggatatttgggggctcattgaggcctacagtgaaaaacaaaatatccaaggataaaaagtagaaagaaggtatctgtgaaaccgctttgtgatgtgtccatgcatcacacagacttaaaacttctctttgatttcacaagttggagacaccctctttgtagaatctgtgaaaggacagttggaagcccactgaggcctgtagtgaaaagctgaatgttcctagataaaaactataaagaagctatctgtgaaacatttttgtgatatgtggattcacctcccagacttaaatctttcttttgattcagcaggttggaaactctctatttgtagaaactgcgactagacatttggaaccccattgattcctatagtgaaaaacagaataatcatgaataaaaactagaaagaagcattctgttaaaccagtttatgatgtgtgtattcacctcacagagttacacttttctactcattcagcaggttgaaacactctttttgtagaatatgtgaagggacattggaagcccaatcatgcctatactaaaatactgaatattcctacataaaaactagaaataatctatctgtgaaaccgctttatgatgtgtggtgtcatctcacagagataaacctttttttttgactaagcaggttggaaacactctttttgtaaaacctgtgaggggttttacaaaccctttgggagaccactgaggcctaaagtaaaaaactgaatatccacaggtaaaaactagaatgaaactttcagtgaaaccactttgtgatgtgtggaatcatctcacaaaagtatattttttttaatgctccagattaaagactgtctttttgtagaatttgtaaagggacagttcagagcccattgaggcctatgggaaaaaagcagaatattcccagatcaaaactagaaagaagctatctgtgaaacttctttgtgatgcttggattcatctcacagagtttaacctttcttttgattcaacaccttagaaacgcttttttttgtagaatctatgaagggacatttgtagaatctatgaagggacatttgaaagttcccatagagaaaaatgggatatttccagataaaagctagaatgaagctatctgtgaaaccactttgtgatgtgtggatacatttcccagaggtaaatcattcttttgatacagcaagttggaaacatactttttttagaaactgcaaaagaaaatcctggcacccattgaggtccaccgtgaaaagactgagtatccccctcaaaaaaaaatagaaagaaggagtctgtgaaattgctttgtgatgtgtggatttatctcactgagttaaacctttcttttgatttcacaagttgaaaatacgttcgtgtagaatctacgaaaggacatttggaagtccactgaggcctgtactgaaaaactgaatattcccacacaaaaaaataaaaactggaaggaagctatctatgaaaccactttgcactgcatggaatcatctcacagacttaaagatttcttttgattcagcaggttggaaacactctttttgtagactctgtgaagtggcatttgagagcccattgaggcctatagtgaaaactgaatatccccagattaaacctagaaagaatctatctgtgaaatggcttttggatatgtgaattcatctcacagagttacatctttcttctgatttagaaggtaggaaacactctttttcaggaatctgtgaagggacatttgggagaccattgatgcttatagtgaaaaaccaaatatccccaaattaatactagaaagaatttatctgtgaaatggctttttgatgtgtagaatcttttgatttagaaggttggaaacactctttttaaggaatctgtgaagggatatttaggagcccttttaggcctatggttgagaaactaaatatcaacagataaaaaatagaaagactctatctgtgaaactgctttgtgaaatgtcaatttatctcacagagttaaatgtttcttttgattcagcacgttaaaaacactctttttgtaaaatctgtgaaggcaaatttggaagcccattgtggcctatgatgaaaaatcaaatatcctcagataaaaactagaaagaaactattggtgaaactgctttgtgatgggtggattcatctcacaaagttaaacctttctttcgattcagcaggttggaaccccttcttttgtagagactgtgaagggacactttgtagcccattgaggcctacagtgaaaaaccaaatatcccttgataaaaactagaaagaagctacctgtgaaatggatttatgatgtgtacaataatctcagagagttaaacctttattttgattcagcaggttggaatcactctttttttagatcctgagaagggacatttggcagctcattgaggcctgtagtgaaaaacagaatatccccagatgaaaagtagaaagaaactatctgtcaaccactttgtgatgtgtggattcatcttacagagacaagcctttgttatgtctcagcagattggaaacactctttttgtagaatctgtgaagagaccgtttgggagaccattgaggctaatagtgaaaaactgaatatccccagataaaaactggaaagatgctatttgtggagccacttcacaatgtgtggattcatctcacagagttcaacctttcttttgatttagcagcttagaaacactctctttgtagaatgcttgggacatttgggagctcattgatgcctatagtgaaaaactgaacaacctaagataaaaagtagaaagaagccatttgtcaaaccacttttcaatttgtggattcttttcacagggataaaactttcttttgatttagcaggttgtaaacactgtttttgcagaatctgtgaatggacattttggagcccattaaggcctgtagtgaaaaaccaaattttttacttaaaacctagataatagatatctgtgaatccactttgtgatgtgtggattcatctcacagagttaaaccattctttttattcagaaaattggacacactctttttgtagaatattcacagggacatttggaagcctattgaggtttaattgaaaaccaaaatatcccaatataaaaactagaaagaatctatgtatgaaacctctttgtgatgtgtcgattcatcttacagagttaaacctctcttttgattcaacagattggagacactctttttgtagaatctgcgaagggacatttgggagcccatttgggtctatagtgaaaaactgaacatccccagataaaaactagaaagaacctctctgtgaaaccttttgcaatgggtgcattcatctcacagaaataaagctttcccttgatgcagcaggttggaagcacactatttaaagaaattttgaagggacatttcaaagcccagtgtggcctataatgaaaactctagtgtccatgaataaaaaatggaaagaaacaatctgtgaaacaactttgtgataggtggattaatctcacagagttaaacctttcttgtgattcagcaggttggaaacattctttttgtagactctgtgaagggacattaaaagtccattgatgcctatactaaaaaactgaatattcctacataaaaacgagaaaaacctatctatctgtgaaagcactttgtgatgtgtcaattcatctcagagagttaaacctttcttttgattcaacagttttccatacttttttttgtggaaactgggaagagatattgaggagaccattgagttatatagtgataaaccaaatatccactgataaaaactagaaagaagctgtatgtgaaattgttcagtgatatgtggattcatatcagagagttaaactttcttttgattcagcagactggaaactctgtatttgtaaaaattgcaaagggacatgtgggagccaattggggcctagagagaaaaacagaatattcatggataaaaactagaagaaagctagctgtaaaatggctttctgatgtgtggattcatctcacagaaattaaactttttttttgattcagcaggttggaaacactctttttgaagaaactgcaaatggacattttggagccccttgagctctataataaaaaagtgaatatccccagataaaaactagaaagaagctatttgtgaaactgcttcatgatgtgtttattcatctcagagatttaaactttcttttgattcagcaggttgcaaacactcttttttgtggaatctgtgaagggacattttggagtccattgatgtcaagagtgaaaaactgaatatccatggatgaaaacaagagagacgctgtctgtgaagccattttgcaatgtgtggattcatctcacagagtgaaacctttcttttgattcagcacgtggaatcactctttttgtagaaacttgaaggagtatttgagagtccattgaggcctatggtgaaaaaccgtatatccctcaataaaaacgggaaagaagtgatctgtgaaactgctttgcaatgtgtggattcatctcacagggttaaacctttcttttgattcagcaaattggaaacactcctcttttagaatttgtgaagggacatttgagagcccattgaggcctatagtgaaaaaccaaatattccccaataaaaactaggaagaagctacctgtgaaaccactttgcaatgtgtggattcatctcacagagtaaaaactttcttttgattcaacaagtttgaaaccctctttttgaagaagctattaagggatatttggaaccctggaggcctatactgaggaactgaatatcaccatatagaagctaaaaagaagctatctgtggaaacgctttcctaagtgtggattcatctcacagagttaaatttctcttttggttcagcaggtgggaaacactgtttttgtagaaactgcgaagggacatttgggagcccattaagcctgtagtgaaaaactgaatagcccttgataaaaactagaaagaagctatctgtgaaactgctttttgatgtgtggattcatctcacagagttaaactttttttttgattcagcaggttgaaaagactctttttatagaaactgcaaaggcacaattgggatctcattgaggtctacagtgaagaacaaaatatctgcagataaaaactagaaaaaaactgtctgtataactgctttgtgatgtgtggattcatctcacagaattctttcttttgattcagaaggttggaaacaggctttagtagaatctatgaagggacatttggcagctcattgaggtgtatagtgaaaaattgaatatcccaaaatgaaaactcaaaagaagctatttttgaaacgtctttttgatgtaagaattcatctcacagagtaaaacctttgttttgatttagcaggatgggaacactattttgtagaatctgtgaagggacatttgggagaccattgaggcctatactgaaaaactgaatatccacatgtaaaaactacaaagaagctatctgtgaagccgctttgtgatgtgtggatttaactcacagagttaaaccttgcttttgactcagcaggttggaaactttctttttgtagaaactatgaagggacatttcaggcccattgaggcctatagagaaaaatcaaatatttcctgatacaaactggaagcaatctatctatgaaattgctttgtcatgtgtggatttgtctcacagcattaaaccttttattttgattcagcaggttggaagcactctttttgtacaatctgcaaagggaattttggagctcactgagggttttagtgaaaaacagcatatcagtgaataaaaaccagaaagaatctatctctgaaactgttttgcaaagtgtggattcatctcacatagttaaatcattcttttgatacagcaggttggaaacactctttttggagaatctgcgaaggaacatttgggagcccctttaggtccataataaaatacctaatatcccccaataaaaactggaaaaaagccatctgtgaatctgctctgtgacttgtgcaatcatctctgagagttaaacctttcctttgattcagcatgttgaaaacactattttgtaaatcctgtgaaggggcatttgggagcaaattgagtcctatagtgaaaaaagacatatccttggataaaaactagaagaacctatctgagaaaccgccttgtgaagtgtggattcattgcacagggttaaacctttcttttgattcagaaggaagaaactgtgaaggggcattttggagaacattcagacttatactgaaaaactaattattcacagataaaaaccagaaacaagctgtctgtgaaactactttctgatgtatggatgcttctcagagacttaaacctttcttttaattcagcaagatggaaacattctttttatagaatctgataagagacatttgggagcccattgaggcctagaatgaataactgaatatctgcagaaaaaaatagaaggaagctaacagtgaaaccactttgtgatgtgtggattcatctcatggagttaaaactttcttttgattcagcaggttggaaacactccttttgtagaaactgcaaagggacttttgggagcccactgaggcctatagtgacaaactgattatcccccagtaaatactggaaagaagctatctgtgaaactactttgtgatgtgttgatttatttcagagaggtaaacctttcttttgaatcctcaggttggaaatgcccttttttgtagaatctgggaatggacattttttacccattaagcctgtaatgaaaaatcaaatatccacagataaaagctaggataaatctatcagtgaaattgctttgcaatgtgtggattcttcccacagagttaaaactttcttttgattcaataaggtaggaaacactctttttgttgaagctgctaaggaacaaatagaagcccattgagggctttacaggaaaacagaatattaccatataaaaactagaaagaagctatctgtgaaaccactttgtgacatgtggattaatctcacagagttaaacctttctattgattcagcaggatgaaaatactctttttgtagaatttgcaaagggaaatctgggagcccattgaggcctatagtgaaaaagaaaatatccacaaaaaaaaaactagaaagaagctatctgtaaaaccactttgcaatatgtggactcatctcccagagttaagtctttcttttgactcagcagttcagaaacactttttttgtagaaaccatgaaaggacatttggaagcccattgaggcatagagagaaaaactgaatatctgtgaatgaaaactagaaagaagctacctgtgaaaccactttgtgatacgtggactcatctccgagaattaagtctttattttgattcagcagttcagaaacttttttttttttgtagaaaccatgaaggaacatttgggagcccattgaagcatagagagaaaaatcaaatatctgcacataaaatctaaaaagaagccatctgtgaaaccatattatgatgtgtggatatttctacagagttaaacctttcttttgattcagcaagttgggaacactttcctatagaatttgtgaagggacatttgtgagccccttgaggcctaaagtgaaaaactgaatatccgcagataaaaactagaaagaagacacctgtaaaattgctttgtgatgtgtgggtttatctctcagagttcaacctttcttttgattcaggaggttggaaacactctttttgtagaatctgtggagggatatttgggagctttttgatgcttatggttgaaaaacccaatatcaacagacaaagtctcgaatgaagctatatgtgaaactgctttgtgatgcctatattcatctaacagagttaagccttgtttcagcagattcagaacattctttttgtagaatcagtgaagagacatttgggagcatattgaggtctattgtgaaaaactgaatatccccagataaacactggaaagaactatctgtgaaactcctttgtgatccatctcacagagttaaacctttcttttaattcatcaggttggaaacacttctcttttgtagaatatgtgaggggacatttggaagcccactgaggcctacggtgaaaaactgaatatttccagggaaaaactagacagaatctacgtgtgaaactgctttgtgatgtgtggattcatcttacagagttaatttttacttgtgattcagaaggttggaaacactcttcttgtagaatctgcaaagggacatttcagagcctattggggccaatggtgaaaaatcaaatattccagataaaaatgagaaggtagctatctgtgaaactgttttgggttgtgtggattgatgtcatagagttaaacctttctttttattcagcaaatgggaaagactctttttgtagaatttgcaaagggacatttgggagcccattgaggcctacattgaaaaatggatatcactagataaaaactggaaagaagctatcaaagagtctgctttgtgatgtgtggattcatgtcacagagttaaatgtttctttagattctgcgggttggaatcattctttttgtagaatttgcgaagggtcatttggtagtccattggggcctatggtgaaaaactgagtatctccagataaaaactggaaaaaagccatctgtgaaactgctttgtgatgtgtcaattcatctcacagagtaaaattttcttgtaattcgtcatgttggtaacgctgtttttgtagaatctgtgatgggacgtttgggagacaatttaaacctacagtgaaaaacagaatatccccagattaaaaataaaaagaagctatctgtgaaactgctttgtgatgtgtgcattcagcaggttggaaactctccttttgcagaatctgcaaagggacatttgggagcccattgaggcctttggtgaaaaactgaatatccatacataaaaactaggaagaagttttgcgtgaaactgctttgtgttgtttggattcatctcgcagaattaaacgtgtcttttgattcagcaggttggaaaccctattttgtagaatctgcaaagggacattagatgggagcccattgaagcctagggtgaaaaactgaatctccccagataaaaactagaaagaagctatctgtgaaagtgctttgtgatgtgtggattcatctcacagaggtaaacctttcttttggttcagccagttggagactcttgttttgtggaagctgcaaagaaacattttggagcccattgaggactatggtgaaaaaaacgaatatccacagataaaaagtagaaagaagctatctgtgaaacttgtttataatgtgtggattcctctcacagaattaactttttttttttattcaataggttggagacactcatttggtagaatctgtgaagggacaatagggagcccattgaggcctacagtgaaaaaccaaatatcactagatgaaaatgagaaagaagctatctgtgaaacagctttgtgatgtttggattcatatcacagagttaaacgtttcttttgatttagcatgataggaaacattctttttgcagaatctgtgaagtgatatttggaaacatgttcaggcctatggtgaaataccaaatattccctgataaaaactagaaagaagttatctgttaaactgctttgtgatgtgtggattcaccaaacaacaaaaaaaactttcttttgagtcagcaggttgaaaacactctttctgtagaatctgtgaagggacgtttgggaccccattgaggcctataatgaaaacaaaaatatccccaaataaaaactagaaagaggctacctgaaaaactgctttggtttaaatggattcatctcacaaaattaaatctttctttagatttagcagttggaaacactctttttgtagactcagcaaaaagacatttgggggccctttgagggctatacttaaaaaaccaaatatcaaaagataaaaactagaatgaagccatctgtgaagttgtttgtgatgtgtggattcatctcacagagttaaacctttcttttatttcaggagattggaaatggtctttttgtagaatctgcaaagagacatgtgggagcctattggggcctatcatgaaaaatggaatatctttagataaaaactagaaacaagctatctgtgaaactgctttgtgaagtgtgtatttatctcacagagttaaatttttttttattcagcacgttgcaaaccctctttttgcagaatctgtgcaggtacatttgtaagcccattgaggcctatggtgaaaaacaaaatatttcctgaaaaaaaaaaaaactaggaaaaggctatctgtgaaactgccttgtgatgtgtggattcaccacacagagataaacctttcctgaaacattctatttgtagtatctgctaagggacatttgggagactacagtaaaaagctgaatatccccagagaaaaactaggaagaagctgtctgtgaaactactttgtgatgtgtggattcatcatacaagttaaaactttctttgattcatcatgttggtaacactcatcttgtagaatcagtgaagggacatttgggagctcgttaagggctaaggtgaaaaacagaatatccccagataaaaacaagaaagaagctatttgtgaaacagctttgtgttgtgtagattcaagtcacagaattaaatctttcttttgattcaaaaggttggaaacactctttttccagaatctgcaaaggggtatttgggatcccattgatgcctatggtgaaaaaccgagtacctttagataaaaactcgaacaaaacctatctgtaaaactgctttatgatgtgtggattcagctcactgagttaaaccatttttttgattcagcaaattggaacctatctttctgtagaacctacaaagggacatttttgagcctattgaggcctaaggtgaaaaactgaatatccccagattaaaactagaaataagctatctgtgaaactgctttgtgatgtgtggattcaccttacagagttaaacctttcttttgattcatcaggttggtaacactctccttgtagaatttgcaaagggacattttggagctcatttaggcctaaggtgaaaaatcgaatatttccaaataaaaactagaaaaaagctatctgtgaaactgctttgtgctgtgtgcattcatctgacagagttaaagctttcttttgattcggcaggttggaaaaagtctttttgtagattctgtgaagggactttggggtcccattgaagcctacattgagaaacagataatccccagatacaaagtaaaaagaagctatctgtgaaatttctttgtgatgtatggatttatctcacagagttaaaacaatcttttgattcagcaggttggaaacactttttttgtagagcctgcaaaaaaacatttgagagcccattgaggcctttggtgaaaaactgaatatccccagataaaaactagaaaaaagttatttgtgaaactgctttttgatgtgtggattcatctcacagatttaaaccattttttatttagtaagttgaaaacactctttttgtagaatctgtgaaaagacatttgagagtccattgaggcctacagtgaaaaaccgaatatccttagagaaaaactagaaagaacctattttgaaactgctttatgttgtgtggattcatctcccagagttaaatttttcttttcattcagcaggttggacatactctttttgtataatctatgaagagacatttgggagctcattgaggcctatggtgaagaaccgaatttccccaattaaaaactagaaagattctatttgtgaaaatgctttgtgatgtgttgattcatctcacagagttaaatctttctttttactcagcaggttgtaaacactctttttgcagtatctgtgaagggacacttgaaagcccattgaggcctctggtgcaaaaccaatttctttggataaaaactagatagaatttatcagtgaatgtgctttgttatgtgtggattcctctcacagagttaaaccttttttttttttttagttcagaacattgaaaacattctttttgtagaacttgtgaagggacatttgggagcccattttggcctatggggaaaaatggaatatccccagataaaaactagaaagaagttatttgtgaaactgctttgtgatgtgtggatttatatcacagagttaaaccttttttttcattcagcaggttgaaaacacttttttttttttttttagaatctgcaaaaggatatttgggagccctatgtggtttatggttaaaaaaactaatataaacagatgaaaactagaatggaactacctatgaaactgctttgtgatatgtggattcatctcacaaagttaaaacttttttttcagaaggttggaaacactgtttttgtagcatctgtgagggacatttgggagcccattgagggctattgtgaaaaacctaatttccctagataaagactagaaacaagctatgtgtgaaactggtgtgtgatgtgtggattcatctcacacagttaaaactttcttttgaatcagcactttggaaacactctgcaagtagaatttgtgaagagacatttgggagcccattgaggcctatggtgaaaaaccgaatatttccagataaaaactagaaagacactacttgtgaaactgctctgtgaggtgtgagattcatctcacaaagttgaaactttttttggattaaacacatcggaaacactctttttgtagaatctgtgaaggaacatttgggagccaattggggcctgcggtgaaaagccgaatattcccagaaaaaaactggaaagacgctatctgtgaaactgctttgtgatgtgtggattcatctcacacagttaaacttttcttttgattcagcctgttgggaaaactctttttgtacaagtggcaatgggacatttgggaatgttttgaggcctgtggtaaaaaactgaatatccccaggtaaaaactagaaagaaactctctgtgaacttgctttctgatgtgtggattcattacagagttaaacatttcttttgattcagaaggttggaaacactgtttttgtatactctgcgatgggacattttggagctcattaaggcctatgatgaaaaaccaaatatctcaagataaaaactagaaaaaagttatctgtgaaactgctttgtaatgtgtggattcatctaacagagttaaacctttcttttcattcagcagcttgaacgcactctttttgtagaatctgcaaagggacatttgggagcccattgaggcttatggtgaaaaactgaatatccccaggtaataactagaaaaaacttatctgtgaaactgctttgtgtggtgtggattcatctcccatagataaatctttcttttgattcagcacattggaaacactttttttgtacactctctgatgggacatttgggagctcattgaggcctatggtgaaaaactgaatctccccaggtaaaaacgagaaagaagctatttgtgaaactgctttgtgaagtgcggattgatctcacggagatcaacttttcctttcattcagcatgttggaaacactttttttgtagaatctgtgaagggacattgggacctctttgaggccaatggtgaaaaactgaatatctccaattaaaacctagacagaatctttctgtgaaactgtgttgtgatgtgtcaattcatgccacagagttaaacctttctttttattcagcaggttgtaaacactctttttgtagaatctgcaaagggacatttaggagcccattgatgcctatgttgaaaaattgaatatccccatgtaaaaactagaaataagctatcagtgaaactggtttgtgatttgtggatttatctcacagatttaaacgtttgtttttattccacaggttggaaacactctttttgtagaatttgcgatgaaacacttgagagccttttgaggcctatggtgaaaaacagaagagcccaagataaaaaactagaagaaatgtatatgtgaaactgctctgtgatacgtggattcaccacacggagtgaaacctttcttttgatgcagtaggtttaacacactctgtttgtacaatgtgcatagggacatttagaagcccattgaagcctatgctgaaaaaccaaatattcccagataaaaactagaaagaagttatctgtgaaactgatttgtgatgtgtaaatacaatgcaaagaattaaacctttcttttaattcagcatgttggaaacgctctttttgtagtatctgtgatgggatatttgagagcccattggggcctatattgaaaaatcgtatataaacctttcttttgattcagcaggttggaaacactctttttgtaggatctgtgaggggacatttgggaacccttggaggtatatggtgaaaaaatgaatgtccccagatagaaacgaaaatgaaactaactgtgaaaatgcctgtgacctgtggattcatctcacagagttgaaactttcttttgattcaacaggttgaaaacactgtatttgtagaatctgcaaagggacatttgggagcccattgatgcctatggtgaaaaactgatactcccagataaaaactgggaagaatgtatctgtgaaactgctttgtgatgtgtggattcaccttacaaagttaaaactttcttttgattcataaggttggtaacactctccttgtagactctgtgaatggacatttgagagcttattgagaactaaggtgaaaaactgaaaatccccagataaaaactagaaagaagctacctgtgaaagtgctttgtgatgggtggaatcatctcgcagagttaaacctctcttttgatacagcagagttggaaacactccttctgtaggatctgcaaagggaaatttcagatcccactgagaactatggtgaaaaaatgaacatctccactaaaaaaccggaaagaagctatgtgtgaaatggctttgtgatgtgccaatttatctcacagagttaaacctttctttaaatgcagcaggttggaaacactttttttgtagaatctgtgaagggacaattgtgagtccattggggcctatggagaaaaactgaatatccccagatgaaaactagaaagaagctatctgtgaaactgctttgtgatgtgtgaaatcacttcacagaattaaacctttcttttcattcaacagattggaaacactctttttgtagaatctgcaaagggatatttgagagcctatagtggcctaaaataaaaaattgattatctaaagttaaaaactagaaagaaactatctgtgaaactgctttgtgatgtgtgaattcatcttacagatttaaaactttgttatgattcagaaggttggaaacactcttattgtagaatctgctaaggggcatttggaagaccactgaagcctaggatgtaaaacagaatatccccagataaaaactagaaagaagatatgtgtgaaactgctttgtgatgtgtggattcacctcacagagttaaaagtttcttttaattcagcaggttggaaacactatttttgtagaatctgcgaagggacatttgcgagtccattgaggcctatggtgaaaaaccaaatatccccagataaatactagaaagaagctatctgtgatgggtggattcatctcacagtgttaaacctttcttttgattcagcaggttggaaacgctctttttgtagaatctgccaaggaacgtctgggggcccattgaagcctatgatgaaaaaccacatatctctaggtaaaaactagaaagaaactatctgggaaactgctttgtgatgtgtggattcatctcacagcgttaaatctgtcttttggttcagcaggatgaatacattcttttgtagcctcttcaaaaacacattttggagcacattgaggcccttggtgaaaactgaacatcacttggtaaaaactagaaagaagatatctgggaaactgctttgtgatgtgtggattcatctaagagatttaaacctttctttttatccagcagtgttttatcaacactctttttgttgaatctgcaaagagacatatgggaacccattgaggcataggataagaaacagaatatccccagataaaaatggaaagaagctatatgtgaagctgctctgtgatgtgtgaactcatcttacatagttaaaactttctgttgactcatctagctggaaactctctttttgtagaatctgcaaagaaacatttgggagcccattgaggtgtaagataagaaacagaatattcccacataaaaactagaaagaagctatatgtgaagcttctctatgatgcgttaattcatcttacagagttaaaactttcttttgattcatctagctggaaactctctttgtgtaggttctgcaaagacacgcttgggagcccattaagtcttatgttgaaaaacagaatatccccaaataaaaactagaaaaaagtttgatgtgaaactgctttgtgatgtgttgattcatctcacagagataaatctttcttttgattcaacaggttgcaaacactctttttgtaatatctgtgaagacacatttgggagcccattgagccctatagtgaaaaactgagcatccctagataaaaactataaagaagctgtctgttcaaccagtttgtgatatatggattcatctcacagatttaaacatttgttttgattcagcaagttgaaatccctctttttgtagaatctgcaaaggggaaactggaggccattgaggattctgctgaaaaacagaataccccagtttaaaaatagaaattatcaacctgtgaaacgtctttgtgatgtgtggattcatttcataaattaaacctttcttttgattcagaaggttggaaacactctttctgtagaaactgcaaattgacatttgggagcccattggggcctgtagtgaaaaactgaatatccccagataacagctagaaagaagctatctattgctttgtgatttgtggattcatctcacagagttaaaccagtctttatattcagtaagtaggaacactgtttttgtagaatctgtgaagggacattggggatcccattgaggtctataataaaaaacccaatatccccagataaaaactagaaagaaattatctgtgaaactgcttggtgatgtgtggattcatctcacagtgatgcacctttattttgattcaacaggttggaaacactctttttgtagtaactgtgaagggacatttgggagcttattttcttatgctgaaaaactgaatattctcagataaaaactgcagagaagcaatctgtgaaactggtttgtgatgtgtggattcatctcatatagtcaaatcttacttttgatcaccaggctggaaacacatttttttttgtagaatctatgaagggacatttgagatcttattgaggcctttggggaaaaactgaataatcccagacaaaatctagaaagaagctctctgtgaaactgcttcatgatgtgtggagtcatctcacagagttaaacctttcttttgattcaataagttggaaacactctttttgtggaatttgtgaagagacatttgggagcccattgaaccctactgggaaaaaccaaatatccccagataaaaactagaaagacattatctgtgaaactgctttttatgtttggattcatctcacacagttaataattttttttttgattcagcattttggaaacacttgtttgcagaacctgcaaagggacatttgggagcacattgaggcctgtggtgaaaaactgaatatctttagataaaaaagaagctagttttgaaactgctttgttaggtgtggattaatctcacaaagttaaatctttcttttgatttaacaagttggaaaaactctttttgtagaatcagtgaagggacatttgagagccatttgaggcctatggtgaaaaaccgaatatccccagagaaaaactagaaagaagatatctgtgaaactgctttgtggtattctcacagtgttttccctttcttttgattcagcaggttggaaacgttctttttgtagaatctgcaaagggacattgggaagcccattgaggtctacagtgaaaaattgagtatcttcagataaaaactagaaagaagctacttgtgaaacttatttgtgatgtgtggattcttctcccagtgttaaacttttcttttgattcaagaggttgaagacactttttacagaatctgcaaatggacatttaagaacccattgaggccaatgttgaaaaacataatatccccagataacaactggaaaaaagctattcgtgaaactcctttgtgatcggtggattcatctcacagagttaaacctttcttttgattcagcaggttggaaacactcttttgcagaattggcaaaaagacaattgggagcgcattgaggcctatggcaaaaaaccaaatatcctcagattaaaactacaaagaccttatctgtgaaactcctttgtgatacgtggattcttctcccagagttcaacctttctgtggattcagcaggttggaaacactctttttgtagaatctgcaaagggatatttggagcttattgaggcctatggtgaaaaactgaataaccccaaataaaatctagaaagtagctctctgtgaaactgctttgtgctgagtggattcgtcttacagaattaaacctttcttttgattcagcaagttggaaacactctttttgtggaatctgcaaaaagacatttgggaacccattgtatgctgtggtgaaaaatcgaatatccccatataaaagctaaaaagaaggtatcagttaaactgctttttgatgtttggattcatctcactcagtcaaatctttcttttgattcagcaaattggaaacactctttgtagaacctgaaaagggacatttgggagcccatggaggcctttggtgaaaaaccaaaaatccctagataaaaactagaaagaagctatctttgaaactgctttgctatgtgtggattcatctcacaaagctaaacctttcttttgattcaacaagtcagaaaaactctttttgtagaatcagtgaagggatattttagagccctttgagttctattgaaaaacagaatatgcccagagaaaaactaaaaagaagctatctgtgaaactgctttgtgatatgtggattcatctcatagagtttaacatctcttttgattcagcaggttggaaatacatttttgcagaaaatgtgaagggagatttggatcccattgagggctatgtggaaaagccaaatatcctcagttaaaagcttgaaattagcaatctgtggaaagtctttgtgatgtgtggtttcatctcagaaagttaaaactttctttagattcagcagattggaaacgtgctttctgtactatctgtgaagggaggcttgggagcacattgtagcttatagtgaaaaatcaagtaatccctgatacaaaccagaaagcagctatctgtgaaactgctttgtgatgtgtagattcatcacaaaaagtgaaatatttctattgattctgcaggttgaaaacacactttctggagaatctttgaagggacatttcaaagacctctgagatctgtggtgcaaaactgaatatccccagataaaaaccagaaggaagctatctgtgaaactgatttgtgatgtgtggattcatctgacaaagttaaaccttaatttagattcagtaggttggagacactatttttgtagaaactgcgaagggacactttggagcccattgaggcctatggtgaaaaaccaaatatccctagataaaaactggaaagaagctatctgtgaaactgctttgtgatgtgtggatttatctcacagagttaaacctttgttttgattcatcaagttgacaacactctttttgtagactctgcagaggaacattcgggatcccattgaagcctgtggtgaaaaaccaaatatccccagagaaaaaaaaatagaaagaaactatctgtgaaagtgctttgtggtgtgtatattcatctcagagagttaaaacattcttttgattaagcaagttggataaacactttttgtagaatcttcaagggacattttagagtccattgaggcctatggtaaaaatccgaatatctccatatgaaaaccaaaaagaagctatatgtgatactgctttgtgatgtgtgaattcatctcacagagttaaaactttcttttgattcaacaggttggaaacactctttttctggaatctgcaaaggagaatttggcagcccattgatgcctacagtgaaaaaccaaatctcccaagacaaaaactagaaagaagatatctgggaactggtttgtgatgtgtggatctatctgacagagttaaaggtttcttttgattcagcatgtgggaaacctcttttgtagaatctgcaaagggaaatttgtgagcccattgaggcctatcatgaaaacccaaatattcccagataaaaatgcaaaagaagctatgtgtgagtctgccttatgatgtgtggattcctctcacagagttaaatctttttttgattcagcaggttggaaaaactatttctgtagaatctgtggagaaacatttgggaatccattccggcctatggtggaaaatgcaataacctctcataaacactagaaagaagctatctgtgaaactgctttgtgatgcttagattcatctcacaaaggtaaaactttcttttgattcagcatttctgaaacactctttttttatcatctgcaaagggacatttgggagaccattgaggcctatggtgaaaaacagaatatcccctgataaaaactagaaagaatctagccgtgaaactgctttgtgacgttatcaacttatcttgcagagttaaatgttccttttgattcagcacgttaaaaatactctttttgtaaaatctgtgaaggcacatttggaagcccattgaggcctatgttgaaaaacagaatatcctttgatacagactagaaagaagctatctgtgaaattgctttgtgatttgtggattcaccacacagagttaaacctttcctttgattccacaaataggaaatactcttttgtagaatctgtgaaggaatatttaagagcctttggaggactatggtaaaaaactgaacatcactgcataaaatcttaaaaaatgttaacagtgaaaatgctttgtgatgtgtggattcatctcacaaagttaaaattttcttttgattcaacaggttggaaatgctctatttgtagaatctgtgaagagatatttgggatcccattgagacctatggtgaaaaattgaatatccccagaaaaaaaaattagaaaaaagcaatctgtacaagtgctttgtgctgtgtatattcaactcagagagttaaaactttcttttgattaagcaggttggaaaaactctttttgtaaaatctgtgagggatatttgggagtaaatttagtcctaaggtaaaaatcctaatatccccataaaaaaactttttttgtgatactgctttgtgatgtgtggatttatctcagagttaaaactttcttttgattcaacaggttcgaaacactctttttctagaatcttcaaaggaacatttgaaagcacattgatgcctatggtgaaaaactgaatatacccagagaaaaactagaaagaagctctctgggaactgctttgtgatgtgtggattcatctcacagagttaaatgtttcttttgattcagcattttggaaacagttttttgtagaatttgcaaagggacatttgggagcccattgagaccaatggtgaaaaagcaaatatccccagaaaaaaaagtagaaagaatttatctatgaaactgctttgtgatgtattgattcatctggcagaattaaacctttcttttgattcagcaggttgtaaacattccttttgtagaatctgcaaaggaacatttgggagtctattgtggcttatggcaaaaaactgaatattccaagataaaaatgcaaaagaagctatgtgtgagtctgccttatgatgtgtggattcctctcacagagtcaaacctttttttgattcagcaggttggaaacactctttctatagaatctgctaagagacatttcagagtccattgaggcccatggtgaaaaactaaataaaccctgataaacgctagaaagaagctatctgtgaaactgctttgcgatgtttggattcatctcacaaaggtaaacctttctttttatccagcaggtttgaatcactcattttttttttttagaatctacaaaggtaaatttttagaccactgtggcttgtgctgaaaaacagaatatcccccaataaaaacgagaaagaagatatttgtgaaactgctttgtgaagtgtgatttatctcagtgagataacttttctattgattcagcaggttggaaacactctttttgtaaaatctgtgaaggaacatttaaaggccactgaagccaatggtgaaaaaccaagtgtcctcagataaaagctaaaaagagaggttaccataaaactgctttagtttgaatggattcttctaaaagagataaacatttctttgcatttagcaggttggaaacactcttgtaaaatctgtgaatggacatatgggagccctttgaggtctattgttgaaaaactgaattatcaacagataaaaaatagaaagtatctatctgtgaaactgttttgtgaaagaggatttgtcttacaaagttaaacatttcttttgattcagcatgttgatagcactttttatagaatctgtgaaggcacatttggaagtccattgaggcctaaggtgaaaaagtaaataccctttgattaaaaactagaaagaagctatgtgtgaaactgctttgtgatgtgtggattcatcacacagagaaaagactttcctttgattcagcagattggaaacactcttttcatagaatctgcaaagggatatttaagagcccttggaggactgtggtaaaaaactgaacatccccagataaaatttaaaaagaagccaacagtgaaaatgctttgtgatgtgtggattcatctcacagagttaaatctttcttttgactcaactggttggaaacactccatttgtataatctgagaagggacatttgtaatcccattgaggccaatggtgaaaaactgaatatcttcaaataaaacctggaagaagctctctgtgaaactgctttgtgatgtgtggattcatcttacaaattaaccctttttttgattcatcaggttggtaaccttctccttgtagaatctgcaaagggatatttgggagctctttgaggcctaaggtgaaaaacaaaatatccccaattaaaaactataaagaatctatctgtaagactgctttgtgatgtgttcattcatctcacaaagttaaacctttctttttattcagcaggttgtacactctttttgtagaatctgcgaagggacatttgggagcccattgaggcctatgatgaaaaactgaatacccacagataaaaattataaagaagttatgtgtgaatctgctttgtgatgtgtggatccctttaacatatttaaaccttttttttttattcagcaggttggaaacactcattttgtagaatatgcaaagggacacttgggagctcattgaggcctatggtgcaaaactgatgtcttcagataaaaaccagataaaagctatgagtgaatctgctttgttatgtgtggatttctctcacagagtttaacctttcttttatttcagcaaattggaaacattctttttgtagaatctgtgaagggacatttggaagcccactgaggcctacagtgaaagatggaatatctccaggtaaaaactagaaagaaattatttgtgaaactgctttgtgatgtgtgtatttatctcaaagagttaaacctttcttttcattcagtagattgaaaacagtcttcttgtacaatctgcaaagggacatttgggagccctttgaggcttatgtttaaaaaactgaataacaacaaatgaaaactagaatgaagttatctgtgaaatgctttgtgaagtgtggattcatctcacagaattaattaacctttcttttgtttcagcaggttggaaacattgtttttgtagtatctgcgagggactcttgggagcctattgaaggctatcatgaaaaacctaatatccatagataaaaactagaaacaagccatcttgaaactgctttgtgatgtgtggattcatctcccacagttaaaactttttttgattcagcaagttggaaacactttttctagaatctgtgaagggacatttgggagcctctggagacttattttgaaagagggaataatcccagataaaaactagaaagaatctatttataaaactgctttgtgatgtgtggattcatctcacagagttaagactttcttttgattcagcaggtgggaaacactctgaatgtggaatttgcaaagggacttttgggagtccattgaagcctgtggtaaaaaaaaaaaaaaaaaaaaagaatatcctaagataaaaactagcaagaagttatctgtgaaactggtttgtgatgtgtggattcatctcacagagttaaaccttcctattgatttagcagtttggaaaaactctttttgtagactctgcaaagaaacatttgggagccctctgagtctgaaaatgaaaaacctactatctccagataaaaactagaaagaagctatctgtgaaacttctttgtgatgggtagattatctcacaaatttaaacctttcttttgattcagcggattggaaacactattttggagaatctatgaaaagacatttgggaggccatggaggcctataatgaaaaactgaacatcgccagataaaaactggaaagaagctatctgtgaaactgctttgtggtgtctgggatcatctcacagagataaaactttcttttgactcagcaggttggaagcactctttttgtagaatctgtgaagggacgttggaaacctcatggagacctatggtgaataacagaatagccccccaaaaatactagaaagaagctatctgtgaaactgttttatgatgtgtgggttcatctcacaggagttaaacctttcttttgatttagcaggctgaaaacactctttttgtaacctctgtgaagggacatttgggagtccattgagacctatggtgaaaaaccacctatccccagataaaaactagaaagaagctaggtgtgaaactgccttgtgatgtgtggactcatctcacagagttaaacatttcttttgattcagcaggttggaaacactctttttgtagaatcagtgaagggacactcaaaagcccattgaggcctatcatgaaaaaccaatatcccaagatgaaaaatagaaagaagctatccatgattctgctttgtgatgtgtggattcctctcacagagttaaatctttattttgattcagcaggttggaaatattccttttttcttgatggagtctcattctgccaccgaggctggagtgcactggcatgatctcggctcactgcaagctctgcctcccagattcatgccattctcctgcctcagcctcccaaacatctgtgactacaggcacccgccactaaacccagctaatttttttttggtgtttttgtagagatgcggtttcaccatgatagccaggatggtctccatcatctcctgaatttgtgatctgcccacctcagcctcccaaagtgctgggatcgcagacatgagccactgcaactgacagaaatattctttctgtagaatctgtgaaggtatatttgaaaccctgttgaggcctatggtgaaaaactgaatatccccagataaaaactggaaagaagctataggtgaaattgatttatgatgtgtcaattcatctcacagagtaaaagctttcttttgattcagcactttgggaacactctttttgtagaatctgcaaagggacatttttgagcccattgaggccatggtgataaactgaacatcttcagatagaactagaaagaagttatctgtgaaattgctttgtgatgtttggattcatctcaaacagataaatacttccttagattcaggaggttggaaacactttttttgtagaatctgcgagtggacatttggaagagcattgaggcctatggtgaaaaacccgatatccccagatggaaactagaaaggaggtatctgtgaagctgctttgtgatgtgtggattcatctaacaaagttcaacctttcttttgtttcagcaggtgcaaaacactcttttttttagaaactacaatgcaacatttgagagtgttaggggactctagtgaaaaatgaaatatctttagataaaagctagaaacaaactatctgtgaaatggctttgtgatatctagattcatttcacagaggtaaatttttcttttgattcagcaggttggaaacactctgtatgtggaattttcaaaggaatatttgagagaccattgaagcctatggtgaaaaaccaaatagctccagatgaaaactaaaaagacactatttgtgaatctgctttgtgatgtgtgaattcatctcacagagttaatccttccttttgatttagcaggttggaagcactgtttttgtagaatctgtgaagggacatttgggagcccattgaggctgatgttaaaaaatagattatccccagataaaaactcaaaagaagctatctgtgaaattttgtgatgtgtggattcatcacacagagttaaacctttcttttgattcagcaggttgaaaacactttttttgctgaatctgtgaagaaaatttcaggagcctattgaggcctatggtgaaaaactgaatatccccagatatacactagaaagaagctatctgtgaaagtgctttctgatgtgtggaatcatttcacagattagacctttctttttattcaaaaggttggaaacacttacttgtagaatctgcccattgatgcctagggtggataaccaaatttcccaagagaaaaactagaacaaagccatctgtaaaagtcctttgtgatgtgtggactcatctcacaaagatatacctttcttttgatttagcaggttggaaacactctttttgtagaatctgcaaagggacatttggaagcacattgaggccagtgtttaaaaactgagtgtcttcagatacgaatgagaaagaagctgtctgtgaatttttttttttgttgtgtgaattcatctcacatagttaaacgtttcttttgatttagcaagatggaaacactctttttgtagaacctgcaaagggacattttgaagcccattgaggccagtggttaaaaactgaatatcttcagataaaactagaaagaagctatctgtgaagctgctttgggatgtgtggattcatctcacagagttaaagctttcttttggttaagcaggttggaaacactcgttttgtagaatctgtgaagggacattcaagagcccattgaggcctatcatgaaaaactgactatcatcagataacaactagaatgaagatatctgtgattctgttttgtgatgtgtggattcctctcacagagttaaaccttcctttgattgagtgggttgtgtagaatctgtgaagggacatttgtgagcactttgtggccgagggtgaaaaacctaatatacccagagaacttgaaagaagctatctgtgaaactgctttgtgatttgtacatccatctcgcagagttaacacattctttaattcagcaggttggaaacactcgttgtgtagaatcagtgaaaggacattggaaaaaatagtgaagcctatggtgaaaaagtgaatatccccagataaaaaatatagggagttatttgtgaaactgctttgtgaagtatggattcatctcatagtgttaaaactgtcttttgttcagcaggttggaatactctttttgtagaatccacaaagaaacattttggagcccatcgagacctatgataaaaatcgaatatctccagattaaaaactagaaagaaggtatcagtgaaactgctttgtgatgtgtggctatatctcacacagttaaacctctcttttgattcagcgggttggaaacactctgtatgtagaatctgcacagggacatttgggagcccctttgaggcttatggtgaaaaaccaaatatcctcagataaaaactggcaagaaggtatctgtgagactgctttgtgatgtgtggattcatctcagagttaatccttttttctgattcaacatgttggaaacactgcttttgtagaatctgtgaagggacattttggagtccattgaggcctaatgtcaaaaactgatatcaaactgatattttgacctaatgtcaaaaacagacaaaaactagaaagaagctttctgtgaattttctttgtcatgtgtggattcctctgatagagttaaacctttcttttgattcagcaggttgtaaatattctttttgtagaatctgtgaagggtcatttgggagcccatttggggctattttgaataaccgaatatccccagaaaaaaactgaaaagaagttatctgtgaaactgctttgtgttgtatccattcatctcacagagtaaaagctttattttgattcagcaggttagaaacactttttttgtggaatatgtgaagggacatttgggggcccattgaggctgatggtgaaaaccagaatatccccagagaaaaactagaaagaagctatctgtgaaattattttgtgatgattggattcatctcacacagataaatttttccttagattcagcagttggaaagacttttttcatagaatctgtgaaaggacatttgtgagcccattgaggcctaccttgaaaaattgaatattcaaagataaaaactataaagaagctctctgtgaaacttctctgtgatgttggctccatctcacagaattaaatctttcttctcattcagcaggtgagagacactctttttgtagaatctgcgaagggacttttgagagcctaaggaggactatcgtgaaaaaccgaatatctttagacaaaaactgaaacaagctatctgtgaaatggctttgtgatgtgtggagtcatctcacagaggtaaacatttcctttgaatcagcaggttgggacactctgcatgtagaattttggaaaaaatatttgagagaccatcaaggcctatagtgaaaaactgaatattcccagataagaactaaaaagacgctatttgtgaaactgctttttgatgtgtgagttcaacttacagagttaaatctttcttttgatttagcaggttggaaacactctttttgtagaatctgagaagggacatttgggaactgattgaagcctatggtgaataacagaatatccacagataaaaactggaagaaagctatctgtgaaactgctttgtgatgtgtggattcatttcacagattagacgtttcttttgattcaaaatgttggaaacggttttttttgtaaattctgtgaagggacaactgggagcccactaatgcctagggtggaaaaccgaatatccccagagaaaaaccagaaaggagttctctgtgaaactgcattgtgatgtgtggactcatctcacagaatcaaaggtttcttttgacttagcaggttggaaaccctctttttgtagaatctgtgagaagacatttgaaagcctatcatggcctatggtgaagaactgaatatccccagataaaagctacaaagaagctatcagtgaaactgcattgtggtgtgtggaatcaactcacagacttaaactgttgttttgatttaacacgttgcaaacacccttttaaatattaaaaaattaaattaaataaattaaattaaattaataatttaaataaataatttaaaaattaaataaaataaattaaattaaatatttaacaattaaattaaataaatatttaaaagctgattgaggactttaatgatcccagatcaaaactagaaagaatctaactgtgaaactgctttgtgaagtgcacattcatttcacggagttaaacctttcttctgattcagcaggttggataaacccttattgtagtatctgcaaagggacatttgggtgcccattcaggcctatggtgaaaaatcgaatatcccaagataaaacagggaagaatttatttgagaaactactttgtgatttgtagactcatctcactgagttagacctttcttttgattcagcagattggaaacaatctttttgtagaatctgcgaagagatatttgggagcttattgatgccaatggttaaacactgaatatctccagatcaaaactagaaagtagctatctgtgaaactgctttgtgatgtgtggattcatctcacagtgttaaaactttctttttttaagcaggtgggaaaaactatttttgtaaaatctgtgaaaggacatttgagagcctatggaggaatatcatgaaaaactgaatatccctacataaaaactagaaacaagctctctgtgaaactgctttttgatgtgtggattcacctcacagagttaaacctttcttttgattaaccaggttagaaacactctgtatgtagaatttgtgaagggatatttgggaacccattgaggcctatggtgagaaagcaaatatccccagataaaaaactagaaagacactatttgtaaatctgttttgtaatttgtcaattcatctcacagagttaaacctttcttttgattcaggagattggaagcaatttttttgaagaatctgtaaaaaacgtttgggagcccaacaatgcctatggtgataaacagagtatcttcaggtaaaaactagaaagaagctatctgtgaaaccgctgtgtgatgtgcctatttatttcaaagattagaccttgcttttgattcaaaaaattggaaacaccctttttgtagattctacaatggaacaattgggacaccattgaagccttgagaggaaaactgaatatccccagagaaaaaacagaaataagctatctgtgaaagtgctttgtgatgtgtggattcatctcacagagataaacctttcttttgtttcagcacgtggaaaacccttttcttgtggaatctgtgaagggacatttttgagcacgttgaggcctatggtgaaaaatcgagtctccccagatacaaactagaaagaagctatctctgaaattgccctgtgatgtgtggatttatctcacagagttaaacctttcttttgattcagcaggttgaaaacactctgtatgtagaattagtgaggggacattttggaggccattgacgcctattgtgaaaaaccaaatatccccagataaaaactagaaagacaatatttgtgaatctgctttttgatgtgcactttcatctcacagagataaaccttccttttattcagcaggttggaaacactctttttgtagaatctgtgaaggtacattatggagtccatggggcctaaggtgagaaaactgaatatccccagataaaaactgtaaagcagctatatgtgatactgctttgtgatgtgtggattcatctcacagagttaatcctttcttttgattcttcagattggaaacacttctttcatagaatctgtgaaaggacatttgggagtccaaagaggcctatggtgaaataccaaatatccccagagaaaaactagaaagaagctatctgtgaaactgatttgtgatatgtagattcatcttacagagttaaacgtttcttttgattcaacagattggaaacacagttttgtataatctgcaaagagacattggggagcccgttgaggcctatggtgaaaaactgaatgtccccagtgaagaactaggaaggagctatctgttaatttgtaatccgtggattcctgtcacagagttaaacatttcttcagcaggttgaaaacagcctttttgtataatctgtgaaggaatatttgggagctcattgatgtctatggtgaaaaacaatatccctagggaaaaactagaaagaagctatctgtgaatctgctttgtggtgggtggagtcctctcacagagacaaacctttcttttgattcagcaggttggaaacactctttttgtaggctctatgaagggacttttgggagcccattgatgcctatggtgaaaaaccaaatatccccagagaaaaactagaaagaagttatctgtgaaagagctgtgtgagaagtagattagtctcacggagttaacactttctttgattcagcaggttggaaattctccttttgtagaatctgcaaatggacatttgaaatagtagtaaggcctacgaataaaaactgaataatatccccagataaaaactagaggaagctatttgtgaaactgctttgtgatatgtggatttatctcacaaagttaaacttttcttttgttcagcaggttgaaaacactctttttgtagaatctgcatagtgacatttggaacctctttgaggcctatggtgaaaacctgaatagcctcagataaaagctagaaagaagctacctgtaaaactgcttgggtttgactggattcatctgacagaatgaaacctattttttgattcagcaggctggaaacactctttttgtagaatctgctaagaaacatttgaaagccctttgaggcctatggttaaaaaactgaatattgacagataaaaactacagtgaagctatctgtgaaacaactttgtgatgtgtggattcatgtcacagagttaagccttatttttgtgttagcatatgggaaacactctttttgtagaatctgcaaagggacttttgagagcctatggaggcctattgtgaaaaacccaatattgctacataaaaactaaaaacaagctatcagtgaaactgctttggatatatggattcatctcacagagttcagcctttcttttgatttagcaggttgaaaacactctttttctagaatctgtgaggggacgtttgggagcccattgtggcctatggtgaaaaactgaatatctgcagataaaaactagaaagaaactatctgtgaaagtacttagagatgtgaatattcatctcaaaataaacctttcttttgagtcaaatgtttggaaacacctttttgcagaatctgcaaatggacaattgggagccaattgatgccttgggtgaaaaactgggtatccccataaagacactagaaagaagccatttgtgaaactgctttgtgatgtgttggttcgtatgacagagttaaacctttcttttgattcagcaggttggaaacactcttttcatagactctgtgaagggactttgggagcccattgaagactatggtgaaaaaaaaaatctccaaataaaaacgagaaagaagctgtctgtgaaattgctttgtaatgtgtggatacatctcacagagttaaacctttcttttgtttcaggagtttggaaacactctgtatgtagactctgcaaaggaacatttgggagttcattgattcttatggtgaaaaactacatattttcaaaataaaactagaaagaaactatctgtgaagctggtttgtgatgtgtggattcatatcactgagttaaacctttcttttgattcagcagtttgggtgcattatttttgtagactctgcaaagggacatttgagagcttattgaagtctgttgtgaaaaacagaatactctcggataaaaagcagaaaatatctatccgtgaaactgcttagtgatgtgtggattaatctcagggagtaaaagcttccttttgattaaggaggttgtaaacactctttttgtagcatctgtcaagggaaattttgttgcccattgaggcgtatggtgaaaaatggaatatccccatataaaaactagaaagaaacaatctctgaaactgctttttgacctgtggattcatgccactgagtgagttaaacctcttttgatttagcatgtttgaaacactctttttgtaaaatctctgaagggacttgggagccctttgaggccaatggttaaaaactgaatatttccagattaaaaattgaaagaaactatttgtgaaagtgctttgtgatgtgtggattcatctcacagattaatcttttttgatacaaaaggttgaaaacactctttttgtagcatctgtgagggacaattgggaccccattgatgcccagggtgagaaattaaatatcctcaaagaaaaactacaaataagctatctgtggaagggctttgtgatgtgtggatttgtctcacagagttaaacctttgttttgattcagcaggttggaaacacttattctgtagaatctgtgaagggacattttggagcacattgaggcctatagtaaaaaaagaaaaagaaattcccctgataaaaaaaaaaaaaaagctgttagtgaaactgctttgcattgtgtggactcatctgtcagagttgaacttttattttggttcagaaggttggaaacacttgttttgtagaatctgcaaagggatatttgggagctctttgaggccaatgtttaaaaacaaaatacctctaaataaaaactcgaaagaagctaacattgaaactgcttcattatgtatgaattcaccttacagagttaaactttttttttaattgagtaggttgtaaacaattgttttgtagagtctgttaatggacatttggaagcccattgaggcctatcatgaaaaaccgaatatattcagataaaaacttgaaagaagctttcagtgaatctgctttgtgatgcactgattcctctcacagagttaaaactttattttgatttgtcaggttggaaacactcttttcatagaatcttgtgaggaagatttgggggcccattgagacccatggtaaaaagccaaatatccccagataaacactataaagaaggtatctgtgaaacagctttgtgacgtttagattcatctcacagagttaaatctttcttttgattcagcaggttggaaacattctttttgtagtatctgtgaagagacgtttgggagcccagtgaggcctatggtgaaaaaccgattatacccagagaaaaactacaaagaagctgtctgtgaagctgctttgtgatgtatcaatcatctacagagttaaacctttcttttgattcagcaggttggaaacactctttttgtagaatctgtgaagggacatttgggagccctttgaggccaatggtgaaaaactgaatatccccagataacaactagaaagaagctgtctgtgaaagtggtttgagatgtgtggattcatctcagattaaaactttcttttgattcgaatgtttggaaacactctttttgtagaatctgtgaagggacaatgggggcccattaaagcttagggtgaaaaaaacaatatccccagaggaaaattagaaagaagccatctgtgaaactgctttgtgatgtgtggcttcatgtgacagagttaaacctttcttttgattcagcatgttagaaatactctttttgtagaatctgtgaagggatatttgggaacctaatgaggactgtggtgaaaaacaaaatatctccagataaaaatgagaaagaagctatcagttaaactgctttgcaacgtgtgcattcgtctcacatagttaaacctttcttttgtttcagtaggttgcaaacactctttttgtagaatctacagagggacaatttggtgcccattgaggcctatgttgaaaaacaaaatatcctcataaaaaactggtagaaaagtattggtgaaattgctttgtgatgtgtcgattcatctcacagagataaacttttatttaaattcagcaagttggaaaaactttttgtaaaatctgcaaagggacatttgatagcccattgagacctatggtgaaaaactgaatatccccagataacaactagaaagaagcagtatttgaaagtgctttgtgatgtgtgggtttctctcacagaattaaacctttcttttcattccacaagttggaaacactctttttttagaatctatgaatggacaactgggagccaaataatgcttatggtgaaaaattgaatatccccagagaaacagtagaaaaaacctacctgtgaaagtgctttgtgatgtgtgcgttcatctcacagagataaacctttcttttgattcagcaggttggaaactttttttgtagaatctgtgaagaatcgtttaggagcccactgaggcctttggtgaaacactgaataaccccacataaaaactacaaagaagctatctgtgaaactgctttgtgatgtatagattcatctcacagagttaaacctttcttttgattcaacaggttggaaacacactttttatagaatctgcaaaaagacattagggatcccattgaattctatgatgaaaaactgaatatgcccagatagaaactagaaagatgctatctgtgaaactgctttgtgatgtgtgaattcatctccttgagttaaatctttcttttgatttagcaggtttgaaacattcttttgtagaatctgcataggaacactggggagcccattgagaccaatggtgagtaacagaaaaaaaactagaaagaagctgtcagtgaaactgctttgtgatgtgtaaattcatatcaaagagttaaaccttgcttttaattcagaaggttggaaacactctttttatagtggtgatgtgtggattcaccacagaaaaataaacctttctttttattcagcaggttggacacaatctatttgtagaatatgcaaatttacatttaggagcccattgaggcctatggtgaaaaaccaaacatccccagataaaaactagtaagaagttatctgtgaaactgctttgtgatgtgtgcattcatctcacagagttaaacctttctgttgattcagcaggttggaaacactatttttgtagaatctgcaaattgacatttaagagcccactgaggcctatggtgaaaaaccgaatgttcccagaaaaaaactagaaagaatctgtgaaactgcattttgatttgcacattcatctcaccaagttaacatatgctttgattcagcaggttggaaacactgtttttgttgaatctgcgaagggacatttggaagcccattgaggtgtatggtgaaaaatcgaatattgccagataaaagcattctttttgtacaatttgtgaggggtcatttgggagcacattgaggcctgtaatgaaaaaccaaatatccccacataaaaaccagaaagaagctatttgtgaaactgtgctctaatgggtggattcatctcacagagttaaacatttctattgattcagtggcttggaaacacttttttcatagaatctacaaaggagcatttgaaagccctttgttgcatgttttttaaaaatggaatgtctctatttaaaaagtagaaacaagctatctgagaaactgctttgtgatgtgtggattcaactgacagagttaaacatttcttttgattcagcaggttggaagcactctgtagaaacatttgggagcacactgagacctgtggtgaaaatctgattatccccagataaaaattagaaagaagctatctgtggaaatgctttgtgatgtttggattcacctcacacagttaaacctctcttttaattcagtgggttggtaaaaatcttttggtacaatctgcaaattgacatttacaagcctattgaggcctatggtgaaaaaagaatatctcaaataaaaactagaaggaaggtatctgtgtcactgctttgtgatgtgtgggttcatctcacagagttaaacatttcctttgattcagcagttggaaacactctatttgtagaatctgtgaagggacatttgggaacccattgagacctatggtggaaaagtgaatatccccggataaaaactagaaggaatctatctgtgaaactgctttgtgatgtctggattcacctcacagatttaaacttttattttgattcagcaggttggaaacactttagatgtaggatgtgtgaagagatatttgggagcccatggaggcctatggtgaaaaatagaatattcccagaaaaatcctaaaaagaatctctttgtgatactgtttgtgatgtgtgcaatcatctcacttaggtaaactgttctcttgattcagcagattagaaacactctttgtagaatctgttaatggacatttgggagcccattgaggcttatggtgaaaactgaatatccccatataaaaactagaaagaagttatctgtgaacagttttgtgatgtgtggattcatctcacatagttatacctttcttttgattcagcaggttggaaacactctttttgtggaatctttggttggatatttgggagtcctttgaggcataggatgaaaaactgaatatctacagataaaaactaggaagaagctatctgtgaaagtgctttgggatgtgtggattcatctaacagaattaaacctttcttttgatttcacaagttggaaacacttttttggtagaatctgtgaagaaatatttgagacctgattgaggatgatagtgaaaaacagaacatccccacataaaaactagaaagaagtaatctgtacactttcattttggcgtgtggattcaactcacagagttaaaccattcttttgattaagcaggttggaaacactatttctgtagaatctaggaagtgaaatttgtgagcccattgatacttatgttgaaaaacgggatatccacagataagaataagaaagaatctatgtatgaatctgctttgtgttgtgtcaattcatctcacatagttacattttttcttttgtttcagcaggtcagaaacactgttttgtagaatctttgaagggacatttggagcccattgaggcctatggtgaaaaactgaatacccccagatgaaaactagaaaggagctatctgtgaaactgttttgtgatatttggaatcatctcacagagttaacatttcttttccctctgcaggttggaaacactctttttgttgaatatgtgaagggacattttggatcccattgaggactactgtgaaaaacaaaatatccccttataaaaacaagaaagaaggtatctgttcaactgctttgcaatgtgtggattcatctcacagagttaaacctttcttttgattcatctgtttggaaacactcttttagtataattggtgaagggacatttgggagctcattgagacctatgataataagctaaatatccccagataaaaggtagatagaagctctctgtaaaactgccttgtgagatgtggattcatctcacagtactaaacctttctttttattcagcaagttgaaaacactctttttgtaaaatctgcaaagaaacatttgaaagcccttgaggcctatgttgaaaaactgaatatcttcagatgaaaactgcaaagaagatatctgtgaaactgctttctgatgtgtgcattcatctcacagagttaaaccgttcttttgattcggcaggttaaaaacactctttttgtagattctgtgaagggaatttgggagcccattgaggtttatggtgaaaaggtgaatatccccacataaaaagtagaaggaaactctctgtgaaattgctttgtgatgtgtggattcaactcacaaacttcattctttcttttgattcaccaggttggaaacagtctttttgtagaatctgcaaagggacattttggggccctttgaggtctatggtgaaaaatcaaatatccccagataaaaactagaaagaagctatgtgtgaaatagctttgtgatgtgtggattcatctcacagagttaaacttttcttttgatttagcaggttggaagctctctttttgtagaatctgcaaagggacatttgggatcccattgagacctatggtgaaaaaccagacatttccagaaaaaactggaaagaagctatctatgaaacccctgtttgatgcgtgctgttatctcacagatataaacctttcttttcatttggatggttggtaacccactttttgtagaatctctgatggacatatcaggtcccattgaagcctatggaaaaaaatgaacttcttcagataaaaaccagaaataagctatgtgtgaaatggctttgtgatgtgtcaattcatctcacagagttaaacctttctttttattcagcatgttggaaacacttttattgtagactctgcaaagtgacattttggagcccattgaggcctatagtgaaaaacagaacacacccagataaaaattagaaagaagctatctgcgaaatgatttctgatgtgtggatttctcttacagagttaatttattttttgattcagcaggttgcaaatattcttttttaagaatctgtgaagggtaatttaaaagcattgaggctggccaggtgtggtggctcatgcttgtaatcccagcactttgggaggccaaggcaagtggatcacaaggtcaggagatcaagaccctcctggctaacacagtgaagccccatctctacaaaaaatacaaaaaacattagctgagtgtgatggcaggttcctgtagtcccagctacttgggaggctgaagcaggagaaaggcaaggaccaaggaggcagagcttgcagtgagccaagatcatgccacttcactccagcctaggcaacagagcgaggctccatctcaaaaaaaaaaaaagcattgaggcctatggtaaaaaacagaatatccctagataaaaactcaaaagaaactatcagtgaaactgctttgtgattggtggatgcatctcacagagttaaacctttcctttgattcatcatgttagaaacactctttttgtagaatctgtgaagggacattagggagccctcttaggcctatggtgaaaaacggaatctctcctgataaaaaaaaaaagaaagaagctatctgttaaactgctttgtgatgtgtggattcatctcacagagttaacctttatatttattcgacaagttggaaacactctttttgtagaatctgtgaaggaacattttgtagcccattaaggcccatactgaacaacaaaatattgctagataaaaacttgaaagagtctgtcttggaaagtgttttgtgatgtgtgaaataatctctcagatttaaacctttcttttgattcagtaggttggaaacactatttttgtagaatctgcaaaggaacatttgagagatcattgaggcgtatggtcaaaaataaaatatccctacataaaaactaaaaagaaactatctgtgagactgctttgtgatttgtagattcatctcacagagttaaatgtttcttttgattcagcagtttggaaacactctttttgtacacagataaacccttctgataaatctcacacaggtaagtccttctgaagattcagcaggttggaaacacttttctctgtagaatctgtgaagggacatttgggagcccattgaggcctatggtgaaaaagtaaatatcccccagaaagaaattagaaagaagctatctttgaaagtgctttgaggtatatggattcttctcacagattaaacctttattttgttcagtagcttgaaaccactctttttgtagaatctgcaaagggacatttaggagtctatttgggtttaccgtgaaaaacagaatatccctaaataaaacaagaaacaagctatctgtgaaactgttttgtgatgtttgggttcatccctcagagttaaaccattcttttaattcaacaggttggaaacactttgtatgtagaatctgcaataggacatatatgacacctttgtggcctatggtgaaaaatgggatatccccatataaaaactagaaagatgctatttgtgaatctgttttgtgatgtgtggattcatctcacaaagttaaaccttttttatgattcagcaggttggaaacagtctttttgtagaaactgtgaagtgacatttgggagcacaatggggcctatagtgaaaaagtgaataccccagataaaaactggaaataagctatctgtgaaactgctttgtgatgtgtggattcatctcacagagtgaaagctttcttttgatacttcaggtttgaaacacttgttttgtagaatctgcaagggatattatacagcccacagatgcctaaggtgaaaaactgaatattcccaaataaaaactagaaagaagctatgtgtgaaactgctttgtgatgtgtcaattcatctcacagagttaaaactttcttttcattcagcagattggaagcacactttttgaagaatctgtgaagggacatttgaaagcccattgaggactatggtgaaaaactgaatattctgagataaaaactagaaagaagttatctatgaaactgctttgtgatgtttgcattcatctcacataggtaaacccttcttttgattcagcaggttggaaacaatttttttagtatctgtgaagggaattttcaaagtctactgaagcctaacgtgaaaaaatcaaatatctccaaataaaatctcaaaagaagctatctgtgcagtgggtttgtcatatgtacattcacctcacagagttacccgtttcttttgattcaacaggtaggaaacactctttttgtataatctgcaaaaggacatatgggagcccattgatgcctatggtaagaaacagaatatccccagataaacactagaaagaaactgccagtgaaactgttctgtgatgtgtggatttagctcactgagttaaaacattttttgattcagaacgttgcaaagattcatgtatagaatctgcaaatggacatttcagagcctattgaggcctatggtgaaaaacatactatctccagttcaaaacttgaaaggacctatttgtgaaactggtttgtggtctgttgattcatatcacaaagataaaactttcttttgattcagcgggttggaaacactctttttgtagaacccgagaatagacatttgggagtccattgaggcctatgttgaaaaacagatatcccaagataaaaactagaaagaagctatctgtgaatctgctttttatgtataaatccctctcacagacttaaacctttcttttgtttcagcaggttggaaaaactctttttgtagaatatgcaaaaggacatttggcagcctattgaagcttatgatgaaaaaccaaatatcccagataaaaaggtagaaacaagctatctgtgaaactgctttgtgatttatggtttcatattccagagagaagcctttcttttcattgagcatattgttaacactctttatagaatctgcgaaggaacatttgtgagccaaatgaaagctaaggtggaaaaacaaatattgccatataaaaaacctatttgtgaaactagtttgtgatgcgtggattcatctgcaagagttaaatctctcttttgattctgcatatttaaacactctttttgtagaatctgcaaaggggcttttgggagcccattgtggcctctgattaaaagctgaatatccacagataaaaactacaaagaatctatctgtgaaactgctttgtgaagtgtggatttatctcatacagataaagttttaatttgattcagcaggttggaaacactctttttgtagaatatgtaaagggacttaggggagctcattgtgccctgtggtgaaaaaccgaatgtcttcagacaaaaactagaaagaagctatcagtgaaactgctttgtgatgtgtagattcatctcacagtgttaaacatttcttttgattcagcagattggaagcattctgtttttagaatctgaaaagggacattttaaagccaattgacacctataaaaaaatggaatatctccagatacaaactagaaagaagctatctgtgaaactattctgagatgggtggattcatctcactaagataaactttgttttgattcatcaggttggaaacactcttattgtagaatctgtgaactgacatttgaacgcccattcagacctgtggtgaaaaactgaatattcacaggaaaaaactagaagggaagtatctgttaaactgctttgtgatatgtggattctgctcacagtgttaaacttttcttttgactcagtagtttcaaaacagtctttttgtataatctgctaatggaaatttggaagcccactgaggcctatggtgaaagaccaaatatccctagatgaaaactggaaagaggctacctgtgaaactgctttgggatgtgtggattcatctctcagagttaaaccttcttgtgattcaacaggttggaaacacatttctgtagaatctgtgaaaagacaattaggagcccgttgtttcctatggttaaaaaccgaatatccccagaggaaaaaaaataagctatctgtgtaactactttgtgatgtgtggattcatctcacagaactaaacttttcttttgattgagaaggttggaaacacttgttttgtagaatctgcaagaagacatttccgtgcccattgaggccaatggtcaaaacccgaatatccccagttaaaaactagagggaagctacctgtgaaactgctttgtgatgtgttgattcatctcacagagttaaatctttcttttcatttggcaaattggacacactgtttttgtagcatctgcaaagaaacatttgaaagcccactgaggcatatggtgaaaaacaatatccccagataaaaactagaaagaagtggtacgtaaaagtgctttgtgatgtggtgatgtgttgattcttctgacagaatgaaatgtttcttttgattctgcaagatggaaacactatttttgtagaatctgtgaagggtcaatttggagccaattgatgcctttggtaaaaaaatgaatatccccacataaaaactagaatgaagctgtctgtaacagtgctttgtaatgtgtggattcatttcacagagataaccctttcttttgattcagtaggttggaaacactgttattgtacaatctgctaagagacatttggaagcccattgaggcttacagtgaaaaactgaatatccccagataaaaacaagaaagaagctatctatgaaactgctttgtgatgtgtggattcattttacaaagataaacttttcttttgttgcagcaggttggaaactctctttttgtagaatctgtgaagaaacatttgggagcccattgatgtctatggtgaaaacccaaatatccccagataaagactggaaagaacctctctgtgaaactgctctgtgatgtgtggattcacctcacaaagttaaacctttctcttgattcaacaggttggaacacacttttggtagaatctgtgaagggagatttggaggcccaatgagacatatggtgaaaaactgaatatccccaagtgaaaattggaaaaaagctatctgtgaaactgctttgtgatgtgtggattcgtctcacacacttacaccattcttttgattccacaggttggaaacactccttttgtagaatctgcaaagagacagtttggagcgaatttattcctaaggtgaaaaaccaaatatccccattaaaaaaactagaaaaatctatctgtgaatgtgctttgggatttgtgaatttattacacagggataaatttttttttgattcaacatgttgaaaagaatatttttgtaaaatctgtgaagggacatttgaaagcccaatgaggcatatggtgacaacttgaatatccgccgataaaaactagaaagaagctacctgtgaaactgctttgtgacgtgtgggttcatttcatagagttaaacctttcttttgattcaacaagttggaaacactctctttgcagaatctgcaaagggatatttgaaaaccctttgaggcctatggtgaaaaccagaatatccccagatataaactagaagaagctatttgtgaaacttctttgtgatgggtgaattcatgtcacagggttaaacctctctattggttaaggaggtttgcaaaactatttatttttgcaactatttattattgaaagcttgtggtgaaaatccaaatactcccagataaaaacgagaaagaagctatcagtgaaactgctttgtgatatgtggattcatctcgcagagttaaacctttcttttgaataagcaaattggaaactctatttttgtggaatatgtgaagagacatttaagagcccattgaggcctatgttgaaaaacaggttatccctagataaatactagaaagaagctatctgttaagctgttctgtgatgtggggattcatctctcagggttaaacctttctgatgattcagcaggttggaaacacttctcttttagaatctgtaaagagacatttgggaacccattgatacctatggtagaaaacagattttcccaagataaaaactagaaagaagatatctgtgaaactgctttttgatgtgtggattaaccacactaacataaacctttctttagattcagctggttggaaacacaatttttgtagaaactgtgaagggacatttgggagccctttgacacctgtggtgaaaaacagaatgccagcagataaaaactagaaagaagctatctgtgtaactgctctgtgatgtgtgaatttatctatcatagtgaaacctttcttttgattcagaaagttggaatctctgttttggaagaatctgtgaaaggacattttggaacttatggaggcataatgtgaagaactaaatattcccagataaaaactagaaagaagctatttgtgaaactcctttgtgatgtgtggattcatgtcacagagttaaatctttctactcatccagcaggttgttaacactctttctgtagtatctgtgaagggacagttgagggcccacacagacctgtggtgaaaaaaataatattcccagataaaaactaggaaaagctatctgtgaaactgttttgtgaagtgtggattcatctcaaagatttaaacctttcttttgattcagaagattggaaacattcttcttgtagaatctgcaaagggacattttggagccctttgaggccaatggtgaaaaaagaatatccccacataaaaactagaaaaaagacatctgtgaaactactttgtggttcttggactcatctcacaaagataaccgtttcttttgattcagcagattggaaatttttttttgcagaatctgcgaatggacatttggaagcccattgaggcctatggtaaaaaactgattatccccagataaaaactaaaaataagctatttaagaaactgttttgtaatgtgtggattcagcttaccgagataaaccttttttttggttcagcaggttggaaacactcttttgtagaatctgcaaaggaatatttggaagccctttgaggcctatgatgaaaaacagaatatccccagataaaaactaaagagaagctatctgtgaaactgctttgtgctgtgtagattcatctgacagagttaagtctttcttttgattcagtgatttacaagcactttttttgaagtatttgtgaaggtacctttgggagcccattaaggcctatggcattaaaccaaaaatcttcaaataaaagtgagaaagaagctctctgtgaaactgctttgtgatatgtggatttatctcacaaagttaaacctttcatttttttaaatgtgcagtttgaattttaatacatttgtacttatagaagatataaacaatttacaaaatgtagaagagatggaatttacccatcatttaaactaaatttttaataatttgttttttctaatttctttctttcatattccaggtaataaagaactatgctatacggaattccattggcattattatacaaaatcatagtagatacactgaaagataaaattcctacaatcaaatatgctactctctggctaaattttctcagtagcattttgcagaatgtttacatctttcatagaagcaaatttattaaaatttcaaatggcacagtgctttacaggaatcacatttattaacactcctttatttattaaaactaataaataattaaactattatatagaccctcctctgtattacaactacaaaggactataaatcatgctgctttaaagacacatgcacacatatgtttattgtggcactattcacaatagcaaagacttggaaccaacccagatgtccaacaatgatagactggattaagaaaatgtggcacatatacaccatggaatactatgcagccataaaaaataatgagttcatgtcttttgtagggacatggatgaaattggaaaacatcattctcagtaaagtatagcaagaacaaaaaagcaaacaccgcatagtctcactcataggtgagaattgaacaatgagaacacatggacacaggaaggggaacatcacactctggggactgttgtggggtggggagaggggggagggatagcattgggagatatacctaatgctagatgacgagttaatgggtgcagcataccagcatggcacatgtatacatatgtaactaacctgcacattgtgcacatgtaccctaaaacttaaagtataataataataaaaaaagaaaaaagatacctattttctaattgtcaccgctaattaccccaagggcagctgttcgttcatctaccaccagctctcctgtgttctgtactgtccatattttgcctctgataatgcataccactaaaaagaatcagggtacctgggaggaaaattgattccagtgttcaagcaggaaaaaaaatggattggtctggaatatccttttgttgtctgaaatgagctattgcttaaaaaatgtcaggagcagtgctaaaggacagaagagcaaacttaacaaggcttccattggctaagctgcaaagaccatcatcataattgtgataataatcatagtagttaaaacctttccttctattcagcaggttggaaacactgactttgtagagtgttggaagggatattttgatgcccatttagccctatgttaaaaaagtgaatattttcatataaaaccttgaaagaagatgtctgtgaaactgctttgtgatgtgtgcattcatttcacagagtaaacagcttctttttattcagcatgttggaaacactgtttttgtagaatcagcaaggagatatttgggagtccgttgaggccaatggtgaaaaaccaaacatctccagatataaactagaaagaagctatctgtgaaactgctttgcaatgtgtggatttatcttgcagagttaaaccttttttttttttgatccagcagtgttgaaacactctttttgtgaaaactacaaaggagtatttgggaatccattgaaacccatggtggaaaaaatgagtatttccacataaaaaacagaaacaagctttctgtgaaactgctttctgacatgtggatttatctcacagagttgaacctttctttcgattcagaatgttgtaaacactctttttgattcagaagtttggaaacaaatggacatttgggagctttctgaggtctatggttaaaaaaggaatttcccagataaaagttagaaagaagctatctgtgaaacttctttgtgatgtgtggattcacctcacagggttaaacgtttctttttattcagctgtttggaaacacacttcttgtagaatctgtgaagggacatttgagagacaattgaggcctatagtgaaaaatcaaatatccccagataaaatatagaaagaagctatttgtgaaactgctttgtaatgtgtggattcatgtcacagggttaaacctttccattgattcagcacgtttgaaaacttttttttttgtaaaattcaggagaagatatttgaaaacccattgagttctatggtgaaaaaccaaatattcccagaaaaaaccttgaaagaagctatctgtgaaactactgtgtgatgtgtggattcatctcacagagttaaacctttcttttgattcagaaggttgtaaacacacttttcatagaatctgtgaagggaaatttcaaagccattgaggcctatggtgagaaactgaatatctccacttaaaaactaaaaagaagctatctgtgaaactgctttgtcatgtgtggatttatctcacagagttaagccattctttttattcagaaggttggaaaaactcttcttataaaatctgcaaaaagacatttgggaattctttgaggcctatggtaaaaaatggattatctccagattaaaaagtagaaataagctatctgtgaaactgctttgtgacgtctggattcatctcacagtttaaagtttcttttggttcagcatgttggaaacaatctttttttagaatttgggagcctattgagtactatggtgaaaaacagaatatccccagataaaaactagaaagaagttatctgtgaaacctctttgtgatgtgtggattcacgtcacaaatttaaacctttctattgattcagcaggtttcaaacacttttttttaaagaatctttgaaaagacagatgaaagttcattgaggcctatggtgaaaaaccgaatatcccagataaaaacttgaaagaaactatcaatgaaactgctttgtgatgtgtggattcacttcacagaattaaagttttgtttgattcagcaggttggaaactttttttttttttttagaatctatgaaggcacattttagagcccattgatgcctgtggtgaaaaaccgaatatcgtcagataaaaactagaaagaagtaatgtgtgaaactgctttctgaggtgtggattcacaattcaccacgtagactgaaacttttctttccactcagcagattggaaacacttttttttttaagaatttaggagcccattgagcattgtggtgaaaaaaccaaacatctccagataaacactagaaagaagctatctctgaaattcctttgtgatgtgtggattcatctcacagaggaaaacccttttttatttatcagcaggttgggaatattcttaatgcagaatctgcagaagaacatttgtgagaccattgagacttatggtgaaaaattaatatccccagataaaaacgagaaaaaatatgttggtgaaactgctttgtgatgtgtcaattcacctcacagagttaaacctttctttggattcagcatgttagaagcacattttttaacattttgaagcccattttggcctaccattaaaaactgaatatccacagattacagagtagaaagaagatctgtgttaaactgctttggatacgtggatttatctaacagaagtaaagctttcctttaattctgcagtttggaaactctttttttgtagaatctgggaagggatatttgagagtcctttgaaaactatcgagaaaaactgaacattccctgataaaactagaaataatctatacgtgaaaactgctttgagatgagtggattcatctcacagggtttaacctttcttttgattcagcaggttggaaacactttttttgtttaatctgtgaagagacattttggagcccactgggaacccaagtgaaaaaccgaatatccacagataaaagctagaaagaatctatctctgaaacagataaaatatttcttctcccagagttaaacctttcttttgattcagcaggttggaaactctctttttgtagaatctgtgaagggacgtttgggagccaattgagacctatggtgaaaaactgaatatcccatgggaaaaactagaaagtagctatctatgaagctgctttgtgatgtgtggatttatcttacagaaataaagctttctttggattaagcatgttggacacactatcattgtagaatctgcaaagggacatttgtgagtccattgagtcctatggtgaaaaatggaatatccccagttaaaaagcagattaaaccttttttaaattcaacaggttgtaaactctttttgttgattctgtgaaaggatatttgagagtccattgaggcctatggtaaaaaactgaacatccaagataaaaactagaaacaaggtatttgtgaaactgctttgtgatatttggattaatctcccagagagaaaatttcttttctttcaacaagttgttaacactctttttgtagaatctgcgaaaagacattggggatcccattgtggtctattgttaaaaatattatttacagataaaaactagaaagaagctgtctgtgaaactgctttatgatgtgtggattcatcttaaggagtcaaacttttctttttattcagcaggttggaagcattcttagtaggatttgggaagggacattttggggcccctagaggcctatgatgagaaaccaaatatctccagactaaaaactagaaagagactatctgtgaaactgttctaagatgtgtggattcatttcacagagttaaagctgccttttgatttagaaggttgaaaacactctttttgtagaatctgtgaagggacatatagagcccattatatcctagggtggaaagtcaaatatccccagataaaaactagaaagaagctatctttgaaactgctttgtgatgtgtgaattcatctcacagagttaaacctttctgttgattcagcaggttggaaacactctttttgtggaatctgctaaatacatttgggagcccattacagactatggtgaaaaacagtataaccccagtggaaaaactagaaagaagatatctgtgaaactgctctggactgtgtggattaatctaataaagttaaactttcctttgatttatcaggttgtaatcactctttttcgtagaatctgcaaagggacatttggaagcccactgaggcctacagagaaaaactgaatatgtgtactatctatgaaactgctttgtgatgtatggattcatctcacagagttaaacctttcttttgattcagcaggttggaaacactttttgtataatcatcaaagggacatttgaaagcccattgtggcctatggtgaaaaactgaatatccccagataaatactggaaagaagctacctgtgaaactcctttgtgatgtgtgcattcaactcaaatattttaattttttaaaattcaacaggttggaaatggttgataagctttcttttgatgcaccaggttggcaactctattattgtaaaagctgtgaaaggactttcaagaaacccttgtgacccatggtgaaaagccaaatatcccctgataaaaactagatagaacctatctgtaaaactgctttgtgatgtgtggatttgtctcactacattacaccttacttttgatttatcaggttggaaatactctttttgtagaatctgcaaagaaatatttgggagccccttgaggcctgcagagaaaaacagattatccccagaaaaagctagaacaatgctatctgtgaaactgctttgtgatgtgtggattcatctcacagagttaaacttttcttttgattcagcaggttggaaacactctttttgtagaatctaagaagggacatatgaaagcccattgtggcctatggtgaaaaactgaatatcctcagataaaactacaatgaagctacctgtgaaactcctttgtaacgtgtgcattcatctcaacaatttaaaaatttcttttaattcagcaggttggaaacactgtttttgtagactattcaaagaaacatttaaggacccattgtgtcctcctgttacaaaccaaaaatccccagatcaaaacaagaaggaagcaatctttgaaactgctttgtcagttgtgggttcatctacaagagttaaaactttcttttgattcaccaggatggcaactttatttttgtaaaatctgtgaaaggacatttaagaacctttgtggcctatggtgaaaaaccgaatatccccagataaaaactagaaagaagctacctgtgaaattgcttgttgatgtgcacttttatctcaaagatttaaacctttcttttgattcagcaggatggaaatacttttttttgtagaatctgtgaagaaacatttggaagccccttgcggcctaaagtaaaaaacagaatatccccagataaaaactagaaagatgctatctgtgaaactgcttttaaatgtgtggattcatctcacagaggtaaacttttcttttcattcagcaagttggaaccactctttctgtagaatatgtgaagggccttttggagcacattgagacctatgttaaaaaacagaatatccccagataaaaactagaaagaagctatctgtgaaattgcttcatgatgcatggattcatctcaaagaggtaagccttccttttgattgagcagcatggaaacacagtatttgtagaatctgggaaggggcattttgtaacccattttttcatatggtgaaaaaccgaatatctgcaattaaaaaatagaatctatctgtgaaactgcttcatgatgcatgtattcgtctcagagagttaaacctttcttttgattctgcagattggaaacactcttttttgtagcaactgggaagggatctttgagagcccattgacttctatgttgaaaaactgaagaaccccagataaagataagaaagaagctatatatgagactgctttatgatgtgtggattcatctcagggagttaaaactttcttttgattcattcggtttgaaacactcttgttgtataatttatgaagaaacatttgggagcccattgatgactatggtgaaaagccaaataaccccagataaaaactagaaagaagatatctttgaaactgctttgttatgtgagtactcatcttaaagagttaaaactttcttttgattcatccagttggaaatgctctttttgtagaatttgtgaagaaacatttgggaggcaattgaggcctatggtgataaatggaatattccaagatgaaaaactatagaaagaactttccatgatactggtctgggatgtgtggattcatctctcagagtcaatcctttcttttgattcaacaggttggaaacactttttgtaaaatcttggaagggacttttggagttcactgaggcctatggtgaaaaactgaatatccccagataaaaaatagaaacaatgtatctttgaaactgctttgtgatggctgtattcttctcacagagttaaacgtttgttttgatccagcaggttggaaaaactctttttgtagaatctacaaaggggaaattggaagcacattgaggcctataatgaaaaatgggcattcccagatcaaaactagaaggaagctatctgtgaacatgctttgttatgtgtggcttcatctcacaaagttcaacttttattttgattcagcaggttggaaacactattttagtggaatctctgatgggacattttggagcccattgaggcctatggtgaaaaactgaatatagctggatgaaaactcaaaaagaggtgtctgtaaaattactttgagatgtgtggatttatctctccatgttaaaccattctattgattcagcaggttgggaaaacactttctgtaaaatctacaaaaggatatttgagacctgtagtggcctatggtgaaaaactgaatatcccctgacaggaactagaaataaattatctgtgaaactgctttgtgatgtgttgattcttttcactgacttaaacctttttttgattcagaaggttggaaaccattttttgtagaatatgcgaagggacatttgggagcccattgaggcctatgttgataaactgaacatacccagataaaaactagaaagaagctatatttaaactgcttatgaagtgtgcattcatctcacaaattaaacctttcttttgattcagcaggttggaaacactctttacgtggaatctgtgaagagacattagggagcccatggaggcctttggtaaaaatctgaaaaatccaagataaaaactagaaataaagcatctgtgaaacttctttgaaatgtgtggattcctctcacagagttaaacctttcttttgattcagctggttggaatcactctttttgaagaatctgcaaaaggacttttggagcccattgaggaatatggtgaaaaagagaatatccctagataaaaactagaaagaaggtatctgtggaatcctttgagatgtgtggattcatctcaagtagctaaacctttcttttgattcagcagattggaaacacagtttttgtagaatctgggaaggggcattttggagtccattgagtcctgtggtaaaaaactgaatatcctcaattaaaaactagaaagaatctacctgagacagtccttcatgatacgtgaaatcatctcacagagttaaaccattcccttgattcagcaggttggaaacactctttttgtagaatctgggaagggacatttgagagcacattgagttctatggggaaaaacagaatatccccagatcaaaacttgaaagatgctatctgtgtaactgctttatgatgcgtggattcatctcaaagagggaaacctttattttgattcagcaggttggaaacactctttttgtagaatttgcaaagaaacatttgggagccctttgaggactgtggtgaaaaaccaaatatatccagataaaaaactataaagaatctaagtgtgaaactgctttgtgatgggtagatttatctcacagggctaaacatttcttttgatccagcaggttggaaactatcttcttgtagaatctgcaaagggatattttgaagcccattgaggctatggtggaaaaccgaacatccctagataaaaactagaaagaagctatctctgaatctgctttatgatgtgtgcattcatctcacagaattcaacctttattttgattcagcatgttggaaacactctttttgtggaatctgcaaagggacatttgaaagcccattgaggcctatgatgaaaaactgaacatccccagataaaatctagaaagaaggtatctgtgaaactgcttgatgatgtgtgaattcaactcacagggttaaacttttctttggattcagcaggttggagacactctttatatggaacatgcaaaggacaattggaagcccattgaggtctatggtaaaaaactgaaaaatccgagataaaaactagaatgaaggtatctggaaagctgctttgaaatgtgtggattcatctcacagagctaaacatttcttttgattcagtgggtggaaaccactctcattgtagaatctgtgaagggacatttggagtttattgaggtctaagttgaaaaacagaatatccacagagaaaaactaaaagaaaaatatctgtgaaactcttttgtgatgtgacgattcatcccagagagttatccctttttttgactcaaaaggttgaaaccattctagtggttgaattagtgaagggacattttagagaccactgaagcatatggtgaaaaactgagtaaccccaattaaaaactagaaagaatgatctgtgaaactgcttcatgacgtttgtactcatctgacaaagctaaaactttctttggattcagctgattggaaatgctctttttgtagaattttggaagggacatttgagagcccattggattttatgttgaaaaaccgaatatccccagataaaaaccagaaagaagctatctgtgaaactgctgtataagctgtggatttatctcaggtagtgaaaccttccttttcatttggcagcttggaaacacactttttgaagaatctgagaagaaacatttggagtcatttgagaaatatggggaaaatctgaatatcccaagataaaaagaagaaagaagctatctttgaaacagctttgtgatgactggattcatcttaaaaagttaaacctttcttttgattcagccaattggaaagcctcttttttagaatctgcaaagtatcatttgggagccctttgtggcatatggtgataaaccaaatatcccaagacaaaaaattagaaagaagttatctgtgatcttctatgggatttttggattcatctcacagagttaagcttttctttagattcagcgggttggaagggctttttgtagaatctggacagagacttttggagctcaatgaggcctatgatgaaaaactgaatattcctagataaaaactagaaagaagctcttggtgaaactgctttgtaatgtgtgaattcatcttaaagagttaaacctttcttttttattcagcaggttggaaacattgcttttgtggaatctgcaaagggacatttgagagcccattaaagcatatggtgaaaaacagaataccccagaagaaagactagaaagaaaatatctgtgaaactgctctgggatgtgtggattcatctcacaaagttaaactttttttaaaattcatcaggttggaaacaggttggaaactttctttgtagaatctgtgaagggacatttggaacccatttgaggcgtatgttgaaaaactgaatatcccaagataaaaaacagagagaagctatctttgaaactgctttgtgatgtgtggattcatctcagagttaatcctttcttttgattcatcagattggaagcacgctttttgtagaatcagggaagggacatttaagagactaatgatgcctatgaagaaaaacaatatcaacagagaaaaaccaaaaatatgctctctgtgaaagtctttcatgatgtgttggttcatctcacagagttcaacctttcttcttatttagcaggttggaaacattctctttgtgaaatctgagaaaggacatttaggagtgcattgaggcctatggtgaaaaaaagaacatctccagataaaaagtagaaagcagctgtctgtgaaactgctttgtgatttgtagattcatctcacacacttaaacctttcttttgatttagcaggttggaaaagctcttttgtagaatctccaaagggatagtttagcaaagaggcaaatggtaaaaagctgaatatcaccagataaaaactataaagaacattctgtgaaactgcttttttatgtgtggattcaactcacagaattaaaactttcttttgattcagtaggttgggtacactctttttgtagaatctggaaagggacatttgggaagccattaaggtctatggtgaaaaaatgaatatccccagttaaatactagaaagaagatatctgtgaaacttcttcatgagaagagatttatctcacacaggtaaacctttcttttgattcagcaggttggaaacactctttttgtagaattctggaagaaatatttgggagcccattgcatcctatggtgaataattgaatatacccagataaactctagaaagaactttctatgaaactgttttatgatgtgtggattcatctcagagagttaaacctttcagtggattcaccaggttggaaacactttttttgtagaatctgcaaagaaacatttgggagcccattgaggtctatggtgaaaaacaacatatccccagaaaaaaaagtagaaagaagatatctgtgaaactgtttcagatgagtggatttatttcacagagttaaacttttcttttgattcagcaggttggaaacactttttgtagcatctgtgaaaagacatttgagagcccactgtgtcctatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaactgaatatctccagatgaaaaactaaaaagaaactatttgtgaaatggctctgggatgtgtggattcatcacaagaggtaaattttttttgattcagcattttgtaaacactctttttgtaaagtctgggaagaaattttggagaaatttggggcttatggtgaaaaatggaatatctccaaataaaatctagaaagaagctatctgtgaaacaactttgtgatgtgtgaattcatctcacagagttaaaacttacgtttgattgagcaggttggaaacactctttttgttgaatctgtgaagtgacatttgggagcccattgatgtctatggtgaaaactgaatatccccagataaaaactataaaaaagctatctgtgagactgattcatgacgtgtgaattcatcttacagatttaagcctttcttttgattcagcagcttggaaacactttttttgtagaatctatgaagagacatttggggcccattgagacatatggtgaaaatcaaatatccccaaatgaaaactagaaaaaagctatctgtaaaagttctatttcaagtgtggatttagttcacagagttaaactcttactttgtttctgcacattggaaacattctttttgtagaatcagcaaagggacatttaactgcccattcatgcctagggtgaaaaatcaaatatcaggagataaagaccagaaagaagctatttttgaaagtcctttgtgatgtgtggattcatctcagagagttcaacttttcttttttttcagcaggttggaaacattttttgtgtaatctgtgaagggaaatttcagagttcattgaggcctatggtgaaaaagagaacatcccccaataaaaagtagaaagaaacaatctgtgaaactgctttgtgatgtgtggattcatctcacagagtaaaaactttcttttgatttagcaggttggaaaaactctttttgtagtatctgcaaagggacatttgggagcccattgagacctatgttgaaatcacatatcttcagataaaaactagaaagaagttatctttgaaactgctttttgatgtgcagattcatctgacagagttaaacctttcttttcatttagcaggttggatacacacttcttgtagaatctgtgaagggacatatgaaagcccattgtggcctatggtgaaaaactgaatatccccagtttaatactagacagaagctatctgtgaaactgttctgtgatgtgtgaattcatcttacagagttaaacttttcttttgattcagcaggtttgatatactctttttgtacaatctgctaagaaatttttggagacaattaaggcctaaggtgaaaaaccaaatatccccagataaatattagaataaagctatctgtgaaactgcttcgtggtgagtggatttatctcacaaagttcaacgtttcctttgattcagcagattggaaacactttttgtaggatctgtgaagggacatttgggagcacattgagtcttacggtgaaaaaccaaatatctccagataaaaaatagaaagaagttacttgtgaaactgctttataatgtgtggattcatgtcagagaggtatacctttcttttgattcagcaggttaaaaacacttttttttgtagactctgtgaagaaacatttgggaacccattgaggactatggtgaaaagcagaataccccagataaaaactagatagaagctatgtttcaaactgctttatgatttgtggattaatattaaaaagttaaacctctctttacactcagtaggttgaaaacgccctttttttagaatctgcaaagtgacatttgggagccctttgaggcctacggtgaaaaacagaatatccacaaacaaaaaactgaaacgaacatactgtgaaactgctctgtgatgtatggattcacctcacaacgttaaactttacttttgattcagtaaattataaaaaatctttttgtagaatctctgaagggacatttgggagcacattgaggactatggtaaaaaaacaaaatatccccattaaaaaaaactaaaaaaaaaaagattgtgaaactgctttgtgacgtttggaatcatctcacagaattaaaactgttttgattcagcgtgttaaaataactctttgtgtggaatatgtgaagggaattttggagcccattgaggcctatggtgaaaacaatttttttccaattaaaaactcaaaagaatctatctgtgaaacagcttcatgatgcatggatttatctcagaaagttaaaactttcttttgattcagcaggttggaaacactctatttgtagaatttaggaagggacatttgagagcctttcgagttctatggtgaagaacccaatatccccagataaaaactggaaaggtgctatctgtgacactgctttataatatgtggattcatctcagagagttaaacattttctgtgattcaacagattggaaacacactttttgaagagtttttgaagggacactaggaagccatttaggcctatggcgtaaatctgaatactcccagataaaaactaggaagaagctatctgtgaaactgccttgagatgagtgcattcatctcacagagttaaacctttcttttgaatttagtgggatggaaacattctttttgtagaatctgcaaatagacatttgggagcctattaagaactatggtaaaaaactgactatccccagataaaaagtagaaagaatctatcagtgaaacttttatggaatgtgtatattaatcttaaagaattaaacgtttcttttgattcagtagattggaaacactctttttgtagaattcacaaagggacattgggagccctttaaggtctacgatgataaagcaaatatcccaaaatgaaaaacaaaaagaagctatctgtgatacagctctgggatgtgtggattcatctcacagagttaaacgtttcttttgattcagcaggttgaaaacactctttttgtaggatctgggaagggactgatggaactcattgaggcctacagtgaaaaaccaaatatctgcagataaaaaagagaaagaacctacctgtgaaactgttttttgttgagtggattcatctctctgacttaaatttgtcttttgattcaacaggttgcatacactcttattgtaaaatctgtgaagataaatttgtcatcccattgaggcctatggtgaaaaatcagtatccccagttagaaactagaaagaagctatctgtgaaactgctttgtgatgtgtggtttcacctcagagagttaaatgtttcttttcttcagcaggtttgaaatatcctttttgtagaatctatgaaaggacatttagagtgcattgaggcctatgataaaaaatcaaatattcctagataaaaagctagaaagaagctatctctaaaactgctttttttatgtgtgggttaatctcacataattaaacctttctttttatttagaaggtaggaaacaacttttttgtagaatctgtgaaatgacatttgggagacccttgaggcctgcagtggaaatccaaatatcccaagatgaaaacaagaaagatgtgatctgcgaaactgctttgtgatatgtggattcatcttacagaattaaacctttcttttgattcagcaggttggaaatactctatttatagagtctgtgaagaaacacttggagctgatggtggcctatggtgaaaactgaatatccccagataaaaactgcaaagaagctgtctgtgaaactgctttgtgatgtgtggactgatatcataaaatttaacctttcttttgatccagcaggttgaaagcactgtttatgtagtatccttgaaaagacattttggagatcattgaggcctagaaacaagaatgaagctatctgtgaaactgctttgtgatttgtggattcaccccatagagttacccctttcctttggctcagaaggttggaaacacaatttttgtagaatctatggagaagcatttgatagcacattgaagcctatggtgaaaaaccaaatatccccagataaaaactagaaagaatctgtgaaacagctttgtgatgtgtggactcatctcatagagttaagcctttcttttgattcagcaagttgaaacactctttttgcagaatctgcaaagggacatttggaagctcattgaagttatgattaaaaactgaatatccctggatgaaaagttgaaagaagctgtctctgaaactgctttgtgatgtgtggattcatctcacagaagtaaacctttcttttgattcagcagttcagtaacacttttttgtagcatctgccaaagtacgtttgggagtcccttgaggcctttagtgaaaaatcaaatatccttagatagaactagaaagaacatatctgtaaaactgctgcttgatgtgtggattcatctcaaagacttaaaccttcctttaggttcttcaggtaggaaacactgtttttgtacactattcgaagaaagatttgggggcccattgaatcctatgctgaaaaattgaatatcgcaagatcaaaacaaaaaagaagctatctggaaaactgctttgtgatgtgtggttttatctcaaagagttaaacctttcttttgattctgaaggttggcaactctctttttgtaaaatctgtgaaaggacatttgggagccaatggtggcctatagtaaaaaacagattattcccagatgaaaactagaaagatgctatctgtgaaactactttgtgatgtctggattcatcttacagagttaaacatttctattgattcagcaggtagggaacactctttttgtagaatatatgaaagtatatatggagtgctttgaggtctacggcaaaaaattgaatatccacagataaaaactggaaacaagccaactgtaacggctttgcaatgtgtgggttcatatcacagagtaaaaacttacttttgatcagcagtttggaaacactctttttgtagaatctgtgaagggacatttaaaaaaaccactggagtcctacggtgaaaaacagaatatccccagataaaaactagaaacaacctatgtgtgaaactgctttgtgacgtgaaggaatatttgggaggccattgagacctatggtgaaacaccaaatatcctcaaataaaaactagaaagaagctatctgtgaagctgctttgtgatgtgtgcatttatctcaaagacttaactttttttttgattcaacagtttggaaacactctttttatagaatatgtgaagggacatttgggagccccttgagacctaaggtgtaaaatcaaatatctgcagataaaaactggaaacaatttatctgtgaaactgctttgtgatgtgtggattcttttcacagagttaaaacttacttttgatcagcatgttggaaacaccctctttggagaatctgtgaagggacatttgagagcccattgaggcctatggagaaataccgaatatcaacagataaaaactagaaagaaacacctgtgaattgacattgtgatgtgtggattcatctcacagagttaaaccttactttttatcagcaggttgggaatactcttgttgtagaatctgcaaagtaacatttgggaactatttgaggtctatcgtggacaacagaatatcaacagataaaaaatgtaactaagctatctgtgaaacttctttgtgatgtgtgaattcatctcatagagtttaacctttctttgattcagcaggtcggaaacactctgtttgtagaatgtgtgaagggacatttaggagaccaatgggcccatatggtgaaaaactgaatatcctcagatgaaaactagaaaggagctatctctgaaactgcttttttatgcgtgattcacctcaaaaaggtacaactttttttgtttgtttcagcaggttaaaaacactgttttttaaaatcagcaagaagacatttgggagcccattgagacctataatgaaatgcaaaatattcacagataaaaactagaaagaagctctctgtgaaatggctttgtgatgtgtgcattcatgtcaaaatgttaaacctttcttctaattcagcatgttggaaacactcttcttgtaaaatttgcataaggatgtttgaaacccagttgaggcctatggtgaaaaacagaacatccctagacaaaaactagaaagaagctatctgtgaaactgctttgcaatgtgtggattcatctcacagagttaaaccttactttttatcagcaggttgcaaacatcctttttgtaaatcctgccaagaaacatttggagcccattgtggcctatggtaaaaaactgaatattccaagataaaaactagaaaaaagctatctatgaaaatgctttctgatgtgtgaacttatctcatggagttaaatctttctttagattcaggattttggaagaactctttttgtagaatctgagggtgcacaaacaggggacattgaggccaatggtgaaaaacagaatatcttctaataaaaactcgaaagaagctatctgtgaaactgctttgtgatgtatggattcatctaagacagctaaacctttcttttgattcacagcttgaaaacactctttttgtgaagtacgtgaagggacatttggagaccatttaggcttatgttgaaaaaccaaatatcttcagataaaaattaaaataagctatatctgaaattgcatggtgatgtgtggattcatctcatagagttaaacccttcttttgatcagcaagttggaaacactgtttttgtagaacatgtgatgggacatttgggagcccattaatgcctatggtcaaaaatggattatccccagataaaaactagaaagaagctatctgtaaaactgcttcatgatgtgttgattcatctcacagagttaaactgttcttttgatcagcaggtgggaaacagttttttcttagaatctgcaaagggatatttgggagcccactgaggcctagggtgaaaaatcgaataaaccacataaaaactagaaagactctatctgttaaactactttgtgatgtgtggattcctatcacagagttaaaccatttttttttgtttcatgaggttgaaaataatctttttgtaaaaaatgctaagggacatttgtgagcccattgaatcctatggtgaaaaaccgaatatcttcagatagaaactagaaagaagatgtctgtgaaacttctttgagatgtgtggatcatctcccagagttatatgtttcttttggttcagcaggatggaaacactctgtagaatttgcaaaaggacatttgggagcctattgaggcatacagtgaaaaacaaagtatctatggataaaaattagaaaggagctatctgtaaaactgctttgtgatgtgtggattcatctcacagagttaaacctttctattaattcagaaggttggaaacacactttttgtagaatctgagaagggatatgtggagcccaggaggcctatggtgaaaaacgaaatatacccagataaaaactagaaagaagctttctgagaaactgttctgtgatgtgtggattcatctcaaagagttaaacatttttttttgcttcagtaggttggaaacacgttttgtagtatgtgcaaagggacatttgggagctttttgatgtctatagtgaaaaaccaaatatcctcagatagaaactacataaaatctatctgtgaaaccagtttgtgacgtgtggatttatctgacagagttaaacctttcttttgattcagcaggttggaaataatctttttgtaaaatctgcaaagggacataaaagagtgcattgagatctatggtgaaaaacagaatatccccagataaaatctagaaagaagctatctgtgaaaccgatttgtgatgtgtgcattgatttcacagggttaaacctttcttttgattcagaaggtttgtggcactgtttttgtagattctgtgaagaaacatttaagagatatttgaagcctgtggtgaaacacagagtattccaaataaaaacttgaaagaagctatctgtgaaacttttttgtgatgtgtggattcatctaacagagttaaacctttctttgattcagcacattggaaatactctttttgtagaatctgtaaaaggatatttgggagcccattgaggcctatggtaaaaaacagaatatttccagataaaaactagaaaaaagctatctgtgtaactgctttgtgatgtttggattcatctcacagaattaaacatttctttttattcagcaggttgaaaactcttttgtacaatctgtgatgggacatttgagggcccattgacgcctatggtgaaaaactgaatatcctgataaaaactcaaaagaaactatctgtgaaactggtttgtgatgtgtagattcatcacacggagttaaacatttctttttattcagcagatgggaaacacttttttgtagaacctgtgaagggacatttgagagcccattgaggtatacagtgaaaaaccaagtatccccaaataaaaactagaaagaagccatctgtgaaactggtttgtgatgtatgcattcatctaactgaagtaaaccttgcttttgattcagcaggtggcaaacactttttcgtagaaactgtgaagggatatttgagtgcccatagagacctatgatcaacaactgaaatttcccagataaaaaaattgaaggaagctagatgtaaaactgctttgtgatctgtgggttaatctcattccttctgaaactattcgaaacaatagaaaaagagggaatcctccctaattcattttatgaggccagcatcatcctgataccaaagccaggcagagatgcaaacaaaacagagaattttagagcaatatccttgatgaacattgatgcaaaaatcccaataaaatactggcaaactgaatccagcagcacatcaaaaagcttatccaccatgatcaagtgggcttcatctctgggacgcaagcctggttcaatatacgcaaatcaataaacctaatccagcatataaacagaactaaagacaaaaaccccttgattatctcaatagaggcagaaaaggcctttggcaaaattcaacaatgcttcatgctaaaaactctcaataaattaggtattgatgggatgtatctcaaaataataagagctatctatgaaaaacccacagccaatatcatactgaatgggcaaaaactggaagcattccctttgaaaactggcacaagacaaggatgccctctgtcaccactcctattcaacatagtgttggaagttctggccaggacaattaggcaggagaaggaaataaagggtattcaattaggaaaagaggacgtcacattgtccctgtttgcagatgacatgattgtatatctggaaaaccccattgtctcaacccaaaatatccttaagctgataagcaacttcagcaatgtctcaggaaacaaaatcaatgtacacaaatcacaagcattcttatataccaacagacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattccatgctcatgggtaggaagaatcaatatcgtgaaaatggccataatgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtaccaaaacagagatatagatcaatgggacagaacagagccctcagaaacaatgccacatatctacaactatctgatctttgacaaacctgagaaaaacaagcaatgggaaaaggattccctatttaatatatggtgctgggaaaactggctagccatatgtagaaaactgaaactggatcccttccttacaccttataccaaaattaattcaagatggattaaagatttaaacgttagacctaaaaccataaaaaccctagaagaaaacctaggcaataccattcaggacgtaggcatggacaaggacttcatgtctaaaacaccaaaagcaatggcaacaaaagccaaaattgacaaatgggatctaattaaactaaagagattctgtgcagcaaaagaaactaccatcagagtgaacaggcaacctacaaaatgggagaaaattttcgcaacctagtcatctgacaaagggttaatatcaagaatctacaatgaactcaaacaaatttacaagaaaaaaaaaacaaccccatcaaaaagtgggcaaaggatatgaacaggcacttctgaaaagaagacatttatgcagccaaaaaacacatgaaaaaatgctcaccatcactggccatcagggaaatgcaaatcaaaatcacaatgagataccaaatcacaccagttagaatggcaatcattaaaaagtcaggaaacaacaggtgctggagaggatgtggagaaataggaacacttttacactgttggtgggactgtaaactaattcaaccatggtggaagtcagtgtggcgattcctcaaggatctagagctagaaataacatttgacccagccatcccattactgagtatatacccaagggactataaatcatgctgctataaagaaacatgcacacgtacgtttattgaagcactattcacaatagcaaagacttggaaccaagccaaatgtccaacaatgatagactggattaagaaactgtggcacatatacaccatggaatgctatgcagccataaaaaatgatgagtttatgtcctttatagggacatggatgaagttggaaatcatcattctcagtaaactatcataagaacaaaaaaccaaacactgcatattctcactcataggtgggaattgaacaatgggaacacatggacacaggaaggggaacatcacactctggggactgttgtggggtggggtcaggggggagggatagctttagaagatatacctaatgctaaatgacgagttaatgtgtgcagcacaccagcatggcacatgtatacatatgtaactaacctgcacattgtgcacgtgtaccctaaaacttaaaatataataataaaaaaaaaatctcacagagttaaacctttcctttgatgcaaccggttggaaacactctttttgtagaatatgcaaagggacatttgggagcttagtgagacctatggtgaaaaaatgaaatgtcatcagacaaaactcagaagaagctatctgtaaaactgcttactgatgtatggattcatctcacagagttaaaagtttccttttactaagatggttggaaacatgctttttgtagaatattcaaagggacttttgtgagcccattgaaatccacggcataaaacaaaatatccccagataaaaactagaaagaagctgtctgtgaaactgctttgtgatgtgggaattcatctcaaacagttaaactttttttttgattcagcacattagaaacactcttgttttagaatcagagaagaaataattaagagccctttgaggcctctgttgaaaaaggaattatctccagataaaaattcgaaagatgctatcatcaaagctgctttgtgatgtgtggattcacctcactgatttaaaccttgcttttgattcattaggttggaaaccttttttgttgaacctgagaagaaacatttgggagcctattgaagcttttgggaaaaaacagaatatcttcagataaaaaccagaaagaagttatacattacattaaactgctttttcatgtatgcatttatctcatagagttaaaccttgcttttgattcagcaggttggcaacactctttttgtagaatctgtgaagggatatttgggagcccattgaggcctatggtgaaagacagaatattcccagataaaaactagaagggagctatctgttaaaatgctttttgatgcatggattcatctcacagagttaaaacgtttttttatttagcagtttggaaacactctttttgtagaaactgcaaagggacatttgggagccaagtgaggcctatgctgaaaaacagaatatccccagataaatagtagaaagcagatatctgggaaaatcctttgtgatgtgtggattcattccaaagagtttaacctatcctttgagtcagcaggttggaaacacctttttgtggaatctgtgaaaggacatttgggaacccattaaagtctatggttaaaaacataatatcccctgataaaaatgggaaggaagctacctgtaaaacttctttgtgatgtgtggattcatctcacagtgtgatacatttctgttgactcagtaaggtggaaacactctttctttagaatctgtgaagttacatttgaaagcctatggtggcctaaggtgaaaaacagattatccccagataatatctaaaagtaagctatctgtcaaactactttgtgatgtgtggattcatctcacagagtgaaaccatacttttgattcaacaggttagaaaccctcttcttatagaatctgtgaaaggacttcaggaccccattgaggcctatgctgtggcctatggtcaaaaacagaatatccccagataaaaactagaaagaatctatctgttatacttctttgtgatgtgtggattcatctcacagtgttaaattgttcttttgcttcaggaggttgaaaacactcattttcttagaaaatgcaaagagacatttgtgaatccattgaggtctatggtgaaagacaaaatattcatgaacgaaaactagaaaggagatatctgtaaaactgctttgtgatgtttggattcatctcacagagtttaactttccttttgattcagcaggttggaaacactctttttgtagaatctgcaaagggacatgtgaagcccattgaaacctatggtaacaaatggaatatccccagacaaaaatgagaaagaagctatctgtgaaactgctctgtgatgtgtagattcatctcacagacggaaacgtttcctttgattccacagtttggaaacacgttttgtagtatctgtgaagggacatttgaaagactattgaggtctaaagtggaaaacctaaaatacccagacaaaaactagaaagaatctatatgtgaaaccggtttgctatgtgtggcttcatcacacagaggtaaatctttcttttgattcagcagattggaatcactctttttgtagaatctatgaaggaacatttgggagcccattgagacctttgatgaaatactgaatatctgcagataaaaactagaaagaagctgtctgtgaaattcctttgtgatgtgtggttttatctcacagggttaaacctttcttttgatataggaggttggtaacactgtttttttagattgtgagaagaaacacttgggagcccattgacgcctatggtgaaaaacagaatattcccagataacaacgaggaataagctatctgtgaaactcctttgtgatatatggattcatctcacaaagttaaatttttctttgattcagcaggttggaaacactctttatgtagaatctacctatggacatttgggagcccattgaggcctatggtaaaaatcagaatatccccagataaaaactagaaaaaagctttctgtgaaactgctttatgatgcatagattcatcttacagggataaacctttcttttgattaagcaggttggaaaccttctctttgtagaatctgtgaagggacatgttggtgccatttatgcctatggtgaaaaactgagtatcttcagataaaaactagaaagaagctggctctgaaacttgtttgtgatgtgtgcattcatgtgacagagttaaacctagcttttcattcagcagttggaaaacccttctttgtagaatctacaaagggacatttgagagcccattgaggcctatagtgaagaacttaatgtccccagataaaaaaaaatattgaaggaaactatctgtgaaactgctttgtcatgtgtggattcatctcacagaggtaaaacattcctttcatccagcaggttggaaacacaccttttgtagaatctgcaaagaggcattttggagccctttgagacctatggcaaaaaaccgaatatactcagataaaactagaaagaagctgtctgtgaaactgcttactgatggatggattcatctcagagagttgaaccttttgttttactgagaaggttggaaaaactttttcgtacaatatttgaagggacaattttgaggccatagaggcctatggtaaaaaactaaatatccccatataaaaaatagaaagagtctatctgctttgtgatgtcaggattcctctcaaataattaaatttttcttttcattcagcacattggaaacactctttttgtagaattggcaacaggacaattaagagtccattgaggcctctggtgaaaaagtgaatatccggagataaaaattagaaagaagctatcttttaactgctttgtgatgtgtggattcatctcacagagttaaatcttgcttttgattcatcaggttggaaacagtttttttatagaatctgtgtagggacatatgggagcccagtgaaacctatgggaaaaaacgaatatcttcagatagaaaactagaaagatgctatctgtgaaactgctttgtgatgtgtacagttatctcaaggagttaaaactttctttggattcagcaggttggatacactgtttttgtagagtcttcaaaaagacatttgggggcccactgaggcctaaggtgaaaactagaaataaagtatctgtgaaactgctttgtgatgctttgatacatctcacagagttaaaccttatatttgatcaacaggttgaaaacactctttttgaagtatttgcaaagggacattttaaagcccattgaggcctatgttgaaacattatatccccagataaaaactaaaaagaagctatctgtgaaactgctctgttatatgtgcattcttcccacagaggtaaacctatcttttgattcataaggtcgaaatcaccctttttgtagaatttgcatagggacatcttggtgcccatagaggctttggttaaaatcagagtatctccagataaaaactagaaagaaactatcacagaaagtgctctgtggtgagcagattcatctcacagtgttaaacctttcttttgactgagcaggttggataaactttttctgtagaatctgagagggaatatttggcagcccattgaggctcatggtcacaaaaaatccccagataaaaaggagacaaagatatctgtgaaactgctttgtgatgtatggatttatctcacagaattgaatctttcctttgattcagcaggtgggaaacactctttttgtagaatctatgaaggttatgtgggaggccttttaggcctttggttaaaaccaaatatcccccaataaaaactagaaagacactatctgtaaaactgccttttgatctttggattcatctcacaaatttaaaactttctttcaattcagaaggttgtacactcttttgtagaatctgtgaagaaacatttggaagacagtgaggcatattgtgagaaaacaaatattgccagataaaaattacaaaggagctatctgtgaaattgttttgcaatgtgttgattcatctcacagacttaaataatttttgattcagcaagtttttaacactctttatgtagaatctgtgaaggaacatttgaaagccctttgagtcctatggtgaaaaacagaatatccccagataaaaactagaaagaaggtatcaatgaaactactttgtgatgtgtggattcatctcacagagttaaaccattattttgattcagcaggttggaaacacttttttttgaaaaatctgtgaatgcatattttggagactattgaagcctagggtgaaaaatcaaatatccccagggaaaaactagaaagcagcaatctgtaaaacaactttcttgtgatgtgtgaattcatctcacagatttaaacttttcttttcattcagcaggttggaaacaatctttttgaagattctgtgacaatttgggagctcatactggcttatagtgaaaaacagattaccccacataaaacaagaaagaagctatctctgaaactgctttctggtttgtggactcaactcacagatttaaaacatcccttttactaagcagattggaagcactctttttgtagaatctacatagagacatttgggagcccattgtggcctttagagaaatactgaatatccccagataaaaactacaatgaagctatcagtgaaactgctttgtgatttgtggattcatctcatggtgttaaacattactttgaattcagcacattggaaatactctttctgtagaatctgcaaaagaacatttggagcccatggtggcttactgtgagaaactgaatatccccaggtaaaaactagaaagaagttatctgtttaactgctttgggatatgtggattcatctcacagatgtaaaactttcttttgactcagcatactggaaacactctattcctagatgttgcaaagtgacatttgagagtccattgaggactgtattgaaaatttaaataactgtagataaaagctacaaagaagatatctgtgaaacttgtatgttatgcgtggattcatctcacatacttaaaactttcttctgattcagcacattggaaacacgctattttttgaacctttaaagaaacatttgggagcacatggaaacactctattttttgaatctttaaaggaatatttgggagcacactgaggcctatggtgaaaaaccgaaaatttcctgatcaaaactagaaaaaagctatctgtgaaacagtttcgtatcgtgtggagtcatctcctagagttaaacctttgttttgattcagtaggttataaataccctctttgtagaatctgtgaagtgacatttggagcccattgaggcctacctatgatgaaaaacagaatatccaaagataaaaactagaaagaagcaatatgtgtaactgctttgtgatgtgtggattcatctcacagagttgaaactttcttttgattcaccaggcttgagacactctttttgtaaaatctgtgaaaatatattttggagcccatagaggcctatggtaaaaattggaacatcttcagataaaaactagaaagaacctatcggtataactgctttgtgatgtgtggattcatctcaaatagttcaacctttcttttgattcagcagattggaaacactctttttgagattctacgtagggacacttgggaacccattgaggcctatggtgaaaaacctattatcccaaaataaaaaccagaaagaagctatttgtgaaagtgctatgtaatgttttgattcattgtacagagttaaacttctcatttggcttctcttttgattcagcaagttggagacaattttttgaaaacattctgtcaagggacatattggagcccattgatgactttgatgaaaaactgaatatctccagataaaaactggaaagaaactatctgtaaaactgctttgtgatgtgtggattcatcccacagagttaaagttttctgttgattcagcaggttgggaagactccttttgtagaatctgtaaagggagattttggagcccatgaagacctacagtgaaaaacagaacatccccaggtaataatagaaaaatgttatctgtgaaactgtcttgtgctgtgtagattcatctcagagagttaaacattggttttgaatcagcaagttgtaaacactgtttttgcagtatgtgcaaagggacatttgggaaaacattgatgcctatgttgaaaaaagggaggttcacagaaaaaactacaaataagctatctgtgaaatagctttgttttgagtttattcatttcactgagttaaagctttgtttagattcagcaagttggaaacaccatttttgtagaatctgtgaagggacatttgaaagcccattgaaacctatggtgaaaaatcgaatatcttcagttaaaaactagaaagaaactatttgtgaaactgctttgtgaggtatgggttcatctgagttaaccctttctttagattcagcaagtcagaaaaccctctttttgtagaatctatgaagggacatttggtacctcattgaggtccctcgtgaaaaaagacatatgcagaaaaactagaaagaagctatctgtgaaactgcattttgatctgtggattcatctcccagggaaaacactttcttttgattcggcacatttgaaacagtcactttgtagaacctgtgaagggacatttgggagcccaatgaaacctattgtgaaaaacagaacctccccaaatgaaaactagaaagaagccatcagaaaaactggtttgcattgtgtgcattcgtctcacagagttgaaacattttttttgattcagcaggttggaaacactcttttttgtagaatctgtgaaggaatatttgggagcccatttagacctatgttgaaaaaccaaacatccccagagtaaaactagaaagaagctatacttgaaactgctttttgatgtgtgagttcatctcacagatttaaacctttctttaaattaagcaggttggaaacactattttaaagatatctttaaagggacatttgggagcccattgaggcctagggtgaaaaaaaaatccccagttaaaaactagaaaaaaagctatctgtgaaactgccttgtgatgtgtggattcatccaatagagttaaaagtttcaatgattcagcagattggaaacactctttttgtagaatctgcaaagaaacattttggggcccattgaggcctatggtaaaacatcaaacatacccaaataaaaagtagaaagaaactatctatgaaactgctttgtgatgtttaaattcatctcaaagagttacatcttttttttgattcagtagatgggaaacactctttctgtagaatctgcaaacggatatttgagagctcattgagacctgaggtaaaaaactaaacatccccagataaaaactagaaaaaagcaatctgtgaaactgctttgtgatctgtggattcatctgacacagtttaaattttctattgattcagcatattggaaatcctcttcttgtagaatctttgaagggacatttttgagcacattgaagcctatggtgaaaacccgaacatccccagataaaaactagagagaatgtatctgtgaaactgatttttgatgtgtggattcatctcacaaagctaaacctttcttttgattgagcaggttagaaaccctctttttgtataatctatgatgggatattttggagaccattgaggcctatcgtgaaaaactgaatatccacagacaaaacctagaaagaaggtgtctatgaaatttattgggatgtgtgtattcatctcacagagttaaaagtttcttttgattcagcaggttggaaacagttttttgtagaatctgtgaagggacattttggagcccaatttagcctattttaaaaaaccgaacaccctcagttaaaaactataaagaaactatgtgtgaaactggtttgtcatgtttgcattcatgtcacagagttgaaatattcttttgattcagaagtatggaacactctttttgtagaatctgcatagagatatttgggagcccattgaggtctatggtgaaaaacagaacatcaaagattaaaactgaaaagacactatctttgaaactgctttgtgatgtgtgggatcatctcccatatcaaaaacattcttttgattgaacatgttggaaactccctttttgtagaatctttgatcagacatttgggaactaattgaggtatatggtgaaaaactgaatattcccagataaaaactagaaagaaactctctgtgaaactgcttcatgatgtgtagattcatctcaaaaagttaagcctatcttttgattcagtaggttggaaaaactctttttgtagaatctgagaggggatatttgggagcccattcaggcatatggtgaaaaattgagtaccctccagataaaaactagaaactatctgtgacactgttttgtgatgtgtggagttatctcacagagttatatgtttctttggactcagcagtttgaaaacactctttttatagaatctgcaaggttacattttagagcccattgaggcctttggtgaaaacggactatcccaagatgaaaactagaaagaagctctctgtgaaactgctttgttttgtgtaatcatctaacagagttaaacctttaaacctctgttttgattaaggaggttggaaacacacttttttggagtgtgtacactccagggaacaatttgtagcccattgaagcctattgtgaaaaacctattatcctcagacaaaaactggaaataagctaactgtgaaactgctttgtgatgtgtggattcatttcacaaagttaaaccttacttttgatcagcaggttggaaacactttttgtagaacctgtgaaaggacatttgggagcagttggggcccatggtgaaacaccgaacatccccagataaaaaatggaaagaagtgatctgtgaaacttattgtgatgtgtggattcatctcacagaggtaaaccatacttttgatacagcaggttggaaacatttttttttttgtagaatatgcaatggaacatttgtgagcccattgaagcatatattgaaaaaccaaatatcaacttataaaaccagaagaaaccatctgggaagccgatttttgatgtgtgaaatttcatctcatggagttaaacttttcttttgatttggcaatttggacaaactctttttgtagattctgtgaagaaacatttggcagcccattcaggtctatggtaaaaaagcaaatatcaccagataaaaactggaaaggagctgtctgtgaaactgcttggtgatgtgtggattcatctcactgagttaaactgttcttttgatcagcaggttggaaaatagtcattctgaagaatctttgatggaacaatttggtgctcattgagtcctacactgaaaaaccaaatacccatgaatgaaaactagaaaggggctgtctgtaaaactgctttgtgatgtgtggatttatctcacggagttaaacccttcttttgattcagcagattgaaaacacagcttttgtaaaatctgtgatggtacaagtggagcccatttaagcctattttgaaaaaaggaatatcctcagataaaaactagaaagaagctatctatgaaactggtttgtgatgtgtggacccatttcatagatttaaacctttcttttgattcaacagtttagaaaaacttgttatagaatctgcaaagggatatttggcagcttattgaaacccatggtgaaaaactgaaattcccctagaaagaagtgctctgtgaaatggttctgtcatgtgtggttacaactcacagaattaaaccgttcttttgactcaacaggttgaaaacactctttttgtagaatctgctaaggggcatttaggaggccaaaaaggcttatggtgaaaaaccaaatattttcttataaaaactagaaagaaggtatctgtgaaacagttttctgatatgtgaaatcatctcatggagttaaacttttctttggactcatcagcttggagacactctttttgtagagtatgtgaagggacattttggtgcccattgagtcctatggtgaaaaacagaatatccccagataaaaactagaaaaatctagctgaaaacttgtttgtgatgtgtagattcatctcacagagataaatcttggattttattcagcaagttggaaacactctttgtgtaaaatctgggaagttacattaggcagcccactgagacctaaggtgaaaaacagaatatccatagattaaaaactagaaagaagcgatctgtgaaactgctttttgatgaatggattcatctcacaaaattaaaactttcttttgactcagcaggttggtaacactttttttgtagattctgtgaggaaacatttgggagccctttaaggcctataatgaaagaccgaatatccccagaggaaaactggaaggaagctatctgtgaaactgctttgtgatgtacggaatcatcccacagttaaacctttattttgattcagccagttttaaacactttttgtgtaaaccgtgaagggacatttgggagcccattgaggcctatggtgaaactttgaatatcccctgataaatactagaaaaaagcaatttgtgaaactgctttgtgatgtgtggatttatctcacagagtcaaacgttttttttggtacagcagtttggaaacactctttgtgaagaatctgcaaagggaaatttggggtcccattgaggcctaaggagaaaaaccaaatattcccagacaaaaactagaaagaagctatgtgtgaaagtgctgcatgatgtgtggattaatcttacacagctaaagttttcttttgattcagcaggtttgaaaaacttcttttgtagaatctgtgaagggacagttaagatccctttgaagcctagagtgaaaaacagaacatcccagataaaaagtagaaagaagccatctgtgtaacttgtttgtgatgtgtgaattcatctcacagagttaaaactttgttttgattcagcaggttagaaattatcttttggtagaatctgcaaaggggcaatttgtagccaattgaggcctatggtgaaaaacggaataccccaagataaaaactagcaggaagctatctatgaaactgctttgcaatgtgtggattcacctcacacagttaaatctctcttttcattgagcaggtcagaaactctttttgtagaatctgtgaagacacatttggaatcccattatggcctatggggaaaaacagaatatccccagagaaaaagaagaaagaagctatctgtgaaactgctttgtgatgtgtggattcatatcacagggttaaaactttctgttgactcagcaggtgaaaaacagtctttttgtaacttctgtcttaggacatttgggagccccttgatgcctgtagtgaaacattgaatatccctagataaaaactggaaagaagttatctgtgaaactgctttgtgatgtgtggattcatctcacgtggataaacctttcttttgactcagcaggttggaaacactcttttaatagaatctgtgaaaagacatttggaacccaatgaggcttatgaggaatgaaaaactgaatatccccagatagaaactagaaagaagttatctgtgaaactggattttgtagggtggacttatctcacagagttaagcctttgtcttgactcagcaggttggaaacactctttttgtagcatctgagaagccacatttgagagcccatttttgcctactgtgaaaatccaaatgatcccagataaaaactagaaagaagctatctgtggaacagttttatgaagtgtggattcatctcacacagttaacacattcttttgattcagcaggctggaaacagtcttttgtggaatctgtggatggacatttgaaatccctttgagacctgtagagaaaacggaatactctcagagaaaaagtagaaagaagctatatgtgaaactgctttgttttacgttgattcatttcaaagagataaacctttctttttattcagaagttggaaacagtctttttgtagggtccgcaaggagacattttggagcccattgaggcttgtagtgaaaaatcaaatatccccagataaaagctagaaagacgctgtctgtgaaacgactttgtgatgtgtggattcatctcacagagttaaacctttcttttgattcagctggttggaaacacttctttttttagaatctgcaaaaggatatttgggagcccactgaagcccttgttgaaaaactgaatattgccaaatgaaaattagaaagaaactatctacaaaactcgtttgtgttgtgttggttcaccacactgagttaactctttctcttgattaacatgttggaaacactctttttttagaatctgcaaagggacattgcagagcccattgaagcctgcagtgaaaaacgaaatatccccagataaaaactagaaagaggaaatctgtaaaattgctttgtgatgtgtggattcatctcacagagttaaactttacttttgatcagcatgttggaaacagtctttctgaagaatctgcaaagagacatttgggagcccattgtggcctttggtgaaaaacagaatatccccagaaaaaaagtagaaaaaactatctgtgaaactgctttgtgatatgtggattcatctcacagagttaaactttaattcagcagtttctaaactctgcttttgtagaatatttgaaaaggcatttgggagcccattgaggcataaggtgaaaaatatcccaagacaaaaaaagaaagaaatatctgtaaaactgctttgtgatgtgtggattcatctcagagagttatatattacttttgactcagcaggctggaaacactctttaagcactctttttgtagaatctgtgaagggacatttgggagaacattgtagcctatggtgaaaaactgaatatcctagataaaaacaagaaagaatttctccatgaaagtactttctgatgtgtgcagtcatctcacagaggtaagcttaaattttctttctgcagaccggtaacacgtctttgtaggatctgcgaagggacattgtttaggccattgagacctgtggtggaaaacagaatatccccaactataaactagaaagaagctaatagtgaaattccttcatgatgtttggattcatctcacaaagataatcctttcttttcattcattcgcttttaagctctctttttgtaggatatgttaagggacattttagagcttattgaggcctatagtaaaaaacaaaatatcctcaaataaaaactagaaagaagctatgtgtgaaagtgcttgatgatgtgtgcattcatctcagagagttaaacctttttttttattcagtgggttggaaacactctttttgtaaaacctgcaacagtatatctgggagagcattgaggcctaaggtgaaaaactgaatatacaaagataaaaactagaaggaagttatctgtgaaactgattttttgaagtttggattcatctcatgaaattaaacctttcatttggttcagcaggttggaaacactctctttatagaaactactaagggacatttgaaagcctattgaggcctatggtgaaaaatagaatatctccagataaaaacgagaaagaagttatctgtgaatctgctttgtgatgtgtgcattcatctcatagcgataaaagtttcttttgatttgactggttggaaacactcttttcatagaatctgggaagaaacatttttgggccccttaaggactatggtgaaaaatcaaatatccccaggtaaaacaaaaaagcagttatctttgaaagtcctttgtgatgtgtggattcatctcacagagttaagtctttcttttgatttagcagttaggaaacactttttttgtagaatctgcaaagtgacatttgggagcccattgaggactatggtgagaaaccaaatatccacagattaaaacgagtaagaagctgtctgcgaatgtgcattgtgatgtctggattcatcacacagggatacaactttcttaaatgcagtaggttttatgcactctttttttagagtctgcgtagggacagttgggaaccctttgaagactgtggtgaaaaaacatatattcccagataaaaactagaagcaagctatctacaaaactgctttgtgatttgtagattcatcttacagtgttaaacctttcttttgaatctgtacattggaaaaactttctttgtagaagctgcaaagagacatttaaggggcaattgaggcctatggtgaaaaactaattatccccagaaaaaaaaaagaaaaaagttatctgtgaaactgctttgtaatgtatggattcaagtcacaaggttaaacagatcttttgattcagctggttacaaacactctttttgtagaatctgtgaagagacatttggtagtgcattgaggcctatggtaaaaaaaaagattatccccctaaagaaaacagaaaaaagctatttgtgaaactgcttattgaggtgtagattcatctcacagagttaaacctttcttctgattcagaagattggaaacactctttttgtggaatttgtgaggggacatttgagagcccgtggaggcctagggtaaaaaattgaatatcccaagataaaaacgagaaagaatctatctgtgaaagtgctttgtaatgtgtggattcatctcccagggttaaacatttcttttgattcagcatgttggagacactcttttgtagaaactgcaaagggaaatttgagagcccattgagtcctatggtgaaaaactgaatatcccaacataaaaactagaaagaagatagctaagatagtgctttgtaatgtgtggatttatcccactgagataaacctttcttttgattcagtgtgttttaagcactctttttgtagcatgtgcaaagggacatttgaaagctgattgggtcatataatgaaaaacagaatatgcccaaataaaaactagaaagaaactgtctgtgacactgctttgtgatgggtggattcatttcacagagttaaaactttcgtcttattcagctgtttggaaacgctccttttgtagaatgtgttaaaggacatttgagagcccatggaggcctaaggtgaaaaactgagtatacccaaatgaaaaccctctgtgaatcttctttgtgatgtgtgtattcatctcagagggttacacctttcttttgattcagcaggttggaaacactctttttgtataatctgcaaagggacatttgggagctgattgaggcctagtataaaaaactgtatatgcctagataaaaactagaaagaagctatcagtgaacctgcttaatgatgtgtggattcatctaacagcgctaaaagtttattttggttaagtaggttggaaaaactttttgtagaatctgtgaagagaaatttaaaagccctttgagggctatggtgaaaaactgaatatcctgagataaaaacaagaaagaagctatctgtgaaactgcttttggatgtgtggattcatccaaaagagttaaacacttcttcgtgttcagcacgttggaaacacacttcttggagaatctacaaatggacatttctaagaccattgtagcctaaggtgaaaaaccgagtatcttcagataaaaactagatataaggtatctgtgaaactactttgtcatgtgtggattcatttcacagagttaaagctttcttttgattcagcaggaagaaaacacactttttgtagaatctgcaaagggacatttggaagcccattgaggcctacgatgagaaacacattatccagaggtaaaactggaaagaagttatctgtgaaactgcttttgatgtgtggatacatctcacagagttcaatgtttcttttgaatcaggaagttggaaacactctttttccagaatcttcaaagaaacacttgggagcccatagaggcatagggtgaaaaatcgaatatcccagtatgcaaactagaaagaagctatctgcgagactgcttttgatgtgcagatacatatcacagagttaaacctttacttttgattcagcaggttggaaacattctttttgtagaatctgcaaaaagacatttcagaacctattgaaggctatggtgaaaaacagaatatccacaggtaaaaattggaaagaaactatctgtaaaagtgctttgtgatgtgtggattcatctcagagttaaacgtttgttttgattcagcaggttggaagctcttcttttgtagaatctgcgaagggaaatttggcaacccagagagtcttgtggtgaacaatagaatatacccaaataaaaattagaaagaagctatctgtgaatctgctttgtgatgtgtggattcatctcacagggttaaacatttcttttgattcactagtttggaaatcctctttttgtagaatctgtgaagggacatttgggagcacattgaggcctaaggtacaaaaccaagtatcccagtatacaaagtagaaaaaagctatctgttaaactgatttctgatttgtggattcatttcatagagttaaattttttttttatttaacatgttggaagctgtctttttatggaatctgcaataagacatttggaagctatttgaggcctaccataaaaaccagatatccccagataaaaactagaaacaagctatcatttaaactgttttgtgatgtgtcatttcatctcacagagttaaaacctttcttttgatttggcaagttggaaacacttttgttgtggaatgtgagaagagacattttgaagcccattgaggctgataatgaaaagcagaaaatctccatataaaaacttgaaagacactatctgtgaaactgctttgtgatgtgtggattcaagttacagatttaaaaccgtcttttgattcagctggttggaaacactcttatgtagaatctgtgaagagacattttggggccctttgaggcctatggtgaaaaccagaatatcctcagataattactagaaagaatctatctgtgaaaatgctttgctatgtgtatattcatctcaaagagttaaaactttcttttgattcagtatgttggaatactttttttgtagaatctgtgaaggaaaattttggagcttattaagtcctatggtgaaaaacggaatattcccagataaaaactagaaagaagctatctgtgaaactgctttgtgatgtgtggactcatctcacagagtaaaacctttcttttgattcagcagtttggaaatactctttttgtagaatctccaaagggacatttgagagcccatgatggtctaccataaaaatctgaggatcctcagataaaaactagaaagaagctatctgtgacactgcttgtgatgtgtggattcatcacaaagagttaaaagtttttttgattcagcaggttggaatcactctttttgtagaaactgtgaagagacatttgagagccctttgaggcacacgctgaaaaaccaattatccaaagataaaaactagaaagaaactatttgtgaaactgcttggtgatgtgtctattcatctcaaaatttaaacatatattttgattcagcaggtttgaaacactgttttgttagaatccgtgaagggatattagagagcccatttaggcatatagtgaaaaaccaaatatcctcacataaaaactagaaagaaactttctgtgaaattgctttgtgatgtgtggattcatctcagagagtttaaccttttttgattcagcagtttggaaacacttctattgtagaatctgtgaagagacattttggagttcatttaggcctatggtaaaaaacaaatatcaccagaaaaaagaactagaaataagctatcggtgaaactgccctgtaattagtggatttgtctcatggagtaaaacttttcacttgattcagtagtttggaaacaccctttttgtagaatatccaaaggaacattttggagcccactgaggtttatgttgaaaaacctaatatccccagataaaaactataaagaagcaaactgtgaagctgctttgtggtgtgtgaattcatctcacagttaaacttttcttttgattcagcatgttggaaacaccctttttgtagaaagtctgaagagacattagggagccctttgatgcctatgttgaaaaaccgattatccaaagataaaaaggagagataagctatgctttgtgatacgtagattcatctcagaaagttaaacctttcttttgatttagcacgtttgaaacactctttttgtaaaatgtgcaaagggacattttggagtccattgaggcctatggtgaaaaacagaatatccctacatgaaaactagaaagaagctatatgtgaaagtgctttgtgatgtgtgcattcatctcacacagttaaaccttgcttttgattcagtaggttggaaacacaccttttgtggaatccatgaagggacatttgtgaactgttggactatggtgaaaaaatgattattcccagataaaaactagaaagaagctacctggtaaactgctttgtgatgtgtagattcatcacacagagatgaacctttcctttgattcagcaggttggaaacacttcttttgtagaatctatgaagggatctttgggagtttattgaggcctatagtgaaaaacagaatatcaccacataaaagctagaaagaagctctctgtcaaattgctttgtgatgtgtggattcatttcatagagttaaacctttgttttcattcagcagtttgaaaacactctttttgtagaagctgcaaaggaacatttgggagcctattgaaatctttggtgaaaaaccgaatattcccagataaaaactagaaggaagctatctatgaagtgctttgtgatgtgtggattcatctcacagtgttaaacctttcttttgactcaacaggtggtaacactcttttgtgaaaatctgcaaaaagacattttggagcactttgagccttatggagaaaaacagagaatccacagataaaaactagaaagaagctgtttgtgaaagtgttttgtgatgtgtggattcatttcacagagttaaaccattcttttgattcggaatgttggaaacactctttttgtagaatctgtgaggggacatttaagagcattcaggactacaatgaaaaactaaatatccccagaaaaactagaaagatgctatttgtgaaagtgctttgtgattggtggatttatctctctgttaaacattttttttattcagcaggtgggaaactgtctttttgtagaatctccagggggacatttttgagcccattgtggactatggtgaaaaactgaatatttcaagataaaaactagaaagaaactatctgtgaaactgctttgtgatttgtggatttgtatcacagagttaaacctttcttttgatacagtaggttggaaacactctttttgtagactctgtgaacagacacttgagagcccattgaggcctatggtgaaaaacaaattgtccctagataaatactagaaagaacctacctgtaaaattgccttctgatgtgtggattcatctcaaagggttaaactttacttttgactcaccaggtggtagcactctttttttttggaatctgcgaagggtcattttggagcccttttgagccctatgttgaaaaacagaaagtcctcagataaaacctagagagaaacttcctgtgaaactgctttttgatatattgattcatcacacagagataaaactttcttttgattcagcaggttggtaacacttctcttgtagaatctgtgaataaacaatttggagcccatttatgcttatggtgaatgaccatttattgccagataaaaagtagaaagaagctatctgtaaaactgctttgtaaggtgtagatttatctcacagagttaaacttttcttttccatcagcaggttgaaaacacagcttttgtagaaactgcaaagggacatttggaatcccactgagtcctatgggtggaaaattgtaaatcaccccataaaatctagaaagaagctttttgtgaaactgctttgtgatgtttggattcaggtcacagagttaaacctttgttttgattcagcaggttgtaaacactcttttagagaatctgcaaagcaacatttttaacccattgaaacctatggtgaaaaactgaacgtccccagataaaaactagaaagaaactacctgagaaactgcttgtgatgtgtggatttttctcacaaagttaaacctttcttttgattcagcatgttggaaacactttttttgtagaatctgcaaagggacattttggtggccattgaggcctatggtgaaaaacagaataaccccagataaaaatgagaaagaagcaatctgtgaaactgctttgtgatgtttggatttatctcacagcattgaacctatcttttgattcagcaggttggaaacacctttttgtagaatctgtaaagggacatttgggattccattgatgcctaaggtgaaaaaccgaatgtccccagagaaaaacatgaaagaagctgtctgagaatctgctttgtgacgtgtagactcctctcacagagtcacccctttctttcaattcagcagtttggaaacactctttttgtagactctgcaaacggtaattttggaacccgagtttgcctatggccaaacaccaaatattcccagataaaaactagaaagaagctctttgtaaaactgctttgtgatgtgtagattcatctcaaaaagttaaaccctccttttcattcagcaggttaaaaacactatttttgtagaatctgcaaagaaacatagtgggcttattgaggcctgtgttgcaaaactgaatatccccagagaaaaacaagaaagaagctacttgtgaaactgccctgtgaagtgtagatgaatctcacagagttaatcctttcttttaattcagcaggtttgaaacaccctggttgtagattctgcaaagagttatttgagagcattttgaggcctatgataaaaaaccgaatatccctagatgaaaactagaagaaagctctttgaaaaactgctatgttttgtgtagattcatctgaaagagttaaacatttcttttctttcagcaggttggaaacactctttttgtagaatctgcaagggacatttgggcacctgttgatgagtatggtgaaaaaccatatgtccccaaataaaaactagaaagaagctatttgtgaaactgctttgggttgtgttgatttatctaacagacttgaacctttcttttgattcagcaggttggaaacattctttttgtggaatcagcaaagagacatttgggagcccattgtggcctatggtgaaaaaaaaaagaatatccccagataaaaactagaaagaagctatctgtgaaattcctttgtaatgagtagatttatcttacagagttaaacttatgttttgattcatcaggttggaaacactctttttgtagaatctgcacagggacttctggagaccatttaaacctatggtgaaaaccgtatatacccagattaaaagtaaaaagaagttatatgtgaaacttctttgtgatatgtgggttcatctcaaggtgttaaacatttcttttgattcagctggttggaaaccctctttttgtagaatctgcaaagggacacattaaccccccttgagaactatggtgaaaaacagaatatcctcagataaaaactagaaagaagccatctgtgaaactgctttgtgataagtggattcatctcacagagttaagcctttctgttgattcagcagtttggaaactgtttgtgtagcatctgcaaagggacttttggaagccaaatgaggccaatggtgaaaaaaagaatatccccagaaaaaaactagaaagaagctgtctgtgaaactgctttgtgatgtttgaattcaccacacagagctgaaactttcttttgattcagcagattggaaacactctttttgtagatctgcaaagggacatttaggagccaactgaagccagtgttgaaaaactggacatccccaaataaaaactagaaaaaagtgatctgttgaactgctttgagatgtgtggattcatctcatagcattaaacatttcttttgattcagcaaattgaaaacactctttttgtagaatctgcaaaggaaatttgggagcccattggggcctatggtgaaaacaccataaaaactacaaaaaatttatctgtgaaaaatgctttgtgatgtgatgattcatctcacagagttaaacttttcttttgatttaaaaggacggaaacacttttttttaaataaaatctgtgtagggatatttggcagcccattgagggctatcatgaaaatcaaaaatccccagataaaaactagaaaaaagctattggtgaaactgctttgtggtgtgtggattcatctcacagagtaaaatttttcttttgattcagcatgttggaaacactcttttttttttataacaaaaccagaaagtt
